United States Patent
Carniel et al.

(10) Patent No.: US 9,492,524 B2
(45) Date of Patent: Nov. 15, 2016

(54) PLAGUE VACCINE

(75) Inventors: Elisabeth Carniel, Issy les Moulineaux (FR); Christian Demeure, Verrieres le Buisson (FR); Anne Derbise, Vitry sur Seine (FR)

(73) Assignee: INSTITUT PASTEUR, Paris (FR)

( * ) Notice: Subject to any disclaimer, the term of this patent is extended or adjusted under 35 U.S.C. 154(b) by 0 days.

(21) Appl. No.: 14/419,925

(22) PCT Filed: Aug. 7, 2012

(86) PCT No.: PCT/IB2012/001609
§ 371 (c)(1),
(2), (4) Date: Feb. 5, 2015

(87) PCT Pub. No.: WO2014/023992
PCT Pub. Date: Feb. 13, 2014

(65) Prior Publication Data
US 2015/0202275 A1    Jul. 23, 2015

(51) Int. Cl.
*A61K 39/02* (2006.01)
*C12N 1/36* (2006.01)
*A61K 39/00* (2006.01)

(52) U.S. Cl.
CPC ............ *A61K 39/0291* (2013.01); *C12N 1/36* (2013.01); *A61K 2039/522* (2013.01); *A61K 2039/523* (2013.01); *A61K 2039/542* (2013.01)

(58) Field of Classification Search
None
See application file for complete search history.

(56) References Cited

PUBLICATIONS

Rosenzweig et al. Appl Microbiol Biotechnol (2011) 91:265-286.*
Derbise A, Cerda Mahn A, Ave P, Blisnick T, Huerre M, et al. (2012) An Encapsulated Yersinia pseudotuberculosis Is a Highly Efficient Vaccine against Pneumonic Plague. PLoS Negl Trop Dis 6(2): e1528. doi:10.1371/journal.pntd.0001528.
Chain, P.S.G., et al., "nsights into the evolution of Yersinia pestis through whole-genome comparison with Yersinia pseudotuberculosis," PNAS, vol. 101, No. 38, pp. 13826-13831 (2004).
Derbise, A., et al., "A rapid and simple method for inactivating chromosomal genes in Yersinia," FEMS Immunology and Medical Microbiology, vol. 38, pp. 113-116 (2003).
Derbise, A., et al., "An Encapsulated Yersinia pseudotuberculosis Is a Highly Efficient Vaccine against Pneumonic Plague," PLoS Negl Trop Dis 6(2): e1528. doi:10.1371/journal.pntd.0001528 (2012).
Pouillot, F., et al., "Evaluation of O-antigen inactivation on Pla activity and virulence of Yersinia pseudotuberculosis harbouring the pPla plasmid," Microbiology, vol. 151, pp. 3759-3768 (2005).

* cited by examiner

*Primary Examiner* — Oluwatosin Ogunbiyi
(74) *Attorney, Agent, or Firm* — Law Office of Salvatore Arrigo and Scott Lee, LLP (57) ABSTRACT

The application relates to a *Yersinia pseudotuberculosis* cell, which comprises nucleic acid coding for expression of at least one *Yersinia pestis* Caf1 polypeptide or of at least one antigenic fragment of *Yersinia pestis* Caf1, more particularly to an attenuated *Y. pseudotuberculosis* cell, which expresses the *Y. pestis* capsule. Said *Y. pseudotuberculosis* cell is exceptionally efficient in protecting against both bubonic plague and pulmonary plague.

19 Claims, 5 Drawing Sheets

*Y. pseudotuberculosis*     *Y. pestis*

V674     V674TnF1     CO92

⇐ ⇐ F1 signal

FIGURE 3

V674pF1     V674TnF1

PLAGUE VACCINE

SEQUENCE LISTING

The instant application contains a Sequence Listing which has been submitted electronically in ASCII format and is hereby incorporated by reference in its entirety. Said ASCII copy, created on May 3, 2016, is named B10007B_SL.txt and is 6,191,728 bytes in size.

FIELD OF THE INVENTION

The application relates to means, which are notably useful for vaccination against bubonic plague and against pneumonic plague, as well as to the biotechnological and medical applications thereof. The means of the application notably comprise Yersinia pseudotuberculosis cells or strains, which express at least one Yersinia pestis Caf1 polypeptide or at least one antigenic fragment of Y. pestis Caf1. More particularly, the means of the application comprise Yersinia pseudotuberculosis cells or strains, which express the Y. pestis F1 protein or capsule.

BACKGROUND OF THE INVENTION

Yersinia pestis, the causative agent of plague, is among the deadliest infectious agents affecting humans. Transmitted by infected fleas, Y. pestis causes primarily bubonic plague. The disease occasionally evolves to pneumonic plague, the most deadly and contagious form of the infection, which is then transmitted from human to human by aerosols.

Since the beginning of the nineties, plague has been included in the list of re-emerging diseases and Y. pestis is classified as a potential biological weapon for terrorist use. Because antibiotic resistant strains of Y. pestis have been observed or could be engineered for evil use, vaccination against plague might become the only means to fight against the disease.

Most efforts made in the recent years focused on subunit formulations combining the capsular F1 antigen and the V antigen (LcrV). Such vaccines however require the use of an adjuvant and repeated injections to confer a mostly antibody-dependent protection.

Other strategies included the attenuation of live Y. pestis by genetic engineering, the introduction of Y. pestis antigens in Salmonella or virus vectors, and DNA vaccination. However, such vaccines are not sufficiently safe and/or efficient against both bubonic plague and pulmonary plague.

Derbise et al. 2012 [bibliographic reference (1)], which has been published on Feb. 14, 2012, describes the construction of a live vaccine against plague. More precisely, it describes the cloning of the Yersinia pestis caf operon, which codes for surface-expression of the oligomeric Y. pestis F1 antigen and insertion of said operon on a plasmid for electroporation into an attenuated strain of Yersinia pseudotuberculosis. In the resulting Y. pseudotuberculosis strain (strain V674pF1), the nucleic acid coding for surface-expression of the monomer unit of the Y. pestis F1 (i.e., at least the Caf1 polypeptide) is contained in said plasmid.

In the Yersinia pseudotuberculosis cells or strains of the application, the nucleic acid coding for surface-expression of the Caf1 polypeptide is contained in the chromosome of said Y. pseudotuberculosis cells or strains. The application demonstrates an exceptionally high vaccination efficacy against both bubonic plague and pneumonic plague. The application further provides comparative experimental data, which notably demonstrate that the cells or strains of the application are more efficient than the V674pF1 strain described in Derbise et al. 2012.

SUMMARY OF THE INVENTION

The present application relates to the subject-matter as defined in the claims as filed and as herein described.

More particularly, the application relates to cell(s), strain(s), composition(s), pharmaceutical composition(s), immunogenic composition(s), vaccine(s), as well as to the biotechnological and medical applications thereof, more particularly to the in vitro and in vivo applications thereof, more particularly to the immunogenic and/or vaccine applications thereof.

A cell of the application is a Yersinia pseudotuberculosis cell, more particularly a recombinant Yersinia pseudotuberculosis cell.

When used for therapeutic purposes, the Yersinia pseudotuberculosis cell of the application is avirulent, more particularly attenuated, still more particularly genetically attenuated.

The Yersinia pseudotuberculosis cell of the application comprises nucleic acid coding for at least one Yersinia pestis Caf1 polypeptide or for at least one antigenic fragment of Yersinia pestis Caf1. More particularly, said nucleic acid codes for the Yersinia pestis F1 protein, still more particularly for the Y. pestis capsule.

Said coding nucleic acid is comprised in, more particularly integrated into the chromosome of the Yersinia pseudotuberculosis cell of the application.

A cell of the application is notably useful as an immunogen against plague, more particularly against both bubonic plague and pulmonary plague.

Chromosomal insertion of said coding nucleic acid leads to unexpectedly higher levels of protection against both bubonic plague and pneumonic plague, more particularly against bubonic plague.

A genetically attenuated Y. pseudotuberculosis cell of the application notably has the following advantages:
  genetic stability: the genome of said Y. pseudotuberculosis cell is much more stable than that of Y. pestis;
  innocuity: said Y. pseudotuberculosis cell can be highly attenuated, e.g., by (partial or complete) deletion of one or more genes essential to virulence mechanism(s), more particularly of three genes essential to distinct virulence mechanisms;
  molecular diversity: when used as a live whole cell vaccine, it offers a high antigenic complexity, which guarantees a response against a broad range of antigenic targets; antigens are in their native form, adequately processed, and produced de novo as long as the bacteria persist;
  easy manufacturing: once developed and validated, live vaccines do not require sophisticated equipments and techniques to be produced;
  immunogenicity: adjuvant is not required, since bacterial antigens (LPS and other pathogen associated signatures) trigger the innate immune system; in addition to antigens common to Y. pestis and Y. pseudotuberculosis, said Y. pseudotuberculosis cell can stably produce the Y. pestis F1 capsule, which is a major vaccine target against Y. pestis;
  single dose administration: this is a major advantage as it greatly facilitates vaccination campaigns and allows a rapid protection;

vaccination possible by two routes: depending on the context, a subcutaneous or oral route of vaccination may be preferred.

The inventors consider that the level of protection against bubonic plague and pneumonic plague that is achieved by the means of the application is one of the most, and probably the most efficient ever reported.

BRIEF DESCRIPTION OF THE FIGURES

Squares=attenuated *Y. pseudotuberculosis* cells, wherein the *Y. pestis* caf operon is carried on a plasmid (*Y. pseudotuberculosis* strain V674pF1).

Triangles=attenuated *Y. pseudotuberculosis* cells, wherein the *Y. pestis* caf operon is inserted into the chromosome (*Y. pseudotuberculosis* strain V674TnF1).

DETAILED DESCRIPTION OF THE INVENTION

The application relates to a *Yersinia pseudotuberculosis* cell.

Said *Yersinia pseudotuberculosis* cell is a recombinant cell.

Said *Y. pseudotuberculosis* cell can be of any serotype, e.g., of serotype I, II, III, IV or V, for example of serotype I. Said *Y. pseudotuberculosis* cell can be a cell of any *Y. pseudotuberculosis* strain.

According to an embodiment of the application, said *Y. pseudotuberculosis* cell or strain is of serotype I.

*Y. pseudotuberculosis* strains are available to the person of ordinary skill in the art, e.g., from collections of microorganisms (e.g., CRBIP, DSMZ, ATCC, NCTC), from commercial sources or by isolation from contaminated biological material (e.g., from contaminated water or soil) or from a contaminated organism (e.g., an infected human or an infected non-human animal).

According to an embodiment of the application, said *Y. pseudotuberculosis* cell or strain is *Y. pseudotuberculosis* IP32953 that comes from the collection of the *Yersinia* Research Unit and National Reference Laboratory [the genome sequence of strain IP32953 is available under accession number NC_006155 (SEQ ID NO: 19), more particularly NC_006155.1 (SEQ ID NO: 19)].

*Y. pseudotuberculosis* is en enteric pathogen. *Y. pseudotuberculosis* infection (or *pseudotuberculosis*) leads to acute digestive disease, sometimes followed by septicemia, and sometimes, but rarely articular and/or cutaneous symptoms.

*Y. pseudotuberculosis* infection in humans usually leads to gastroenteritis. In some countries such as Russia and Japan, specific strains of *Y. pseudotuberculosis* cause Far East scarlet-like fever (FESLF), characterized by erythematous skin rash, desquamation, exanthema, hyperhemic tongue, reactive arthritis, toxic shock syndrome, septicemia.

In non-human animals, *Y. pseudotuberculosis* is a frequent cause of morbidity and sometimes mortality.

Therefore, when the *Y. pseudotuberculosis* cell of the application is intended for a therapeutic application, it is (or has been made) avirulent, i.e., said *Y. pseudotuberculosis* cell is safe enough to be administered without any danger of clinical infection, either for the recipient or for any contact of the recipient. In other words, the risk associated with the administration of said *Y. pseudotuberculosis* is minimized, if not totally eliminated.

More particularly, said *Y. pseudotuberculosis* cell has lost the ability to cause *pseudotuberculosis*, more generally to cause enteric disease and septicemia.

According to an embodiment of the application, said avirulent *Y. pseudotuberculosis* cell is still capable of growth, more particularly of replication in a host organism (such as a human or a non-human mammal), but has lost ability to cause said disease in said host organism.

According to an embodiment of the application, said *Y. pseudotuberculosis* cell is avirulent to a healthy mammal, more particularly to a healthy human being.

Said *Y. pseudotuberculosis* cell can be naturally avirulent, or it can be avirulent by genetic and/or chemical attenuation.

Methods for attenuation of pathogenic bacteria are known in the art. Genetic attenuation can be achieved by inactivating one or more gene(s) involved in metabolic pathway(s) of the bacteria, more particularly in one or more pathogenic mechanism(s) of the bacteria, and/or by inactivating one or more gene(s) involved in or responsible for the production of virulence factor(s) of the bacteria.

According to an embodiment of the application, said *Y. pseudotuberculosis* cell is genetically attenuated.

According to an embodiment of the application, said *Y. pseudotuberculosis* cell is irreversibly attenuated.

According to an embodiment of the application, said *Y. pseudotuberculosis* cell is genetically and irreversibly attenuated.

According to an embodiment of the application, said *Y. pseudotuberculosis* cell is attenuated by partial or complete deletion of one or more genes, still more particularly by partial or complete deletion of one or more genes involved in or responsible for the production of virulence factor(s) of *Y. pseudotuberculosis*. Such genes comprise the High Pathogenicity Island genes (HPI), the yopK gene and the psaA gene.

Partial or complete deletion of genes can be achieved e.g., by allelic exchange following homologous recombination (cf. bibliographic references (1) and (8), i.e., Derbise et al. 2012 and 2003).

Partial deletion is achieved to an extent sufficient to inactivate the function of the gene.

According to an embodiment of the application, said *Y. pseudotuberculosis* cell is attenuated by partial or complete deletion of one or more genes selected from the HPI genes, the yopK gene and the psaA gene, for example by partial or complete deletion of two or more genes selected from the HPI genes, the yopK gene and the psaA gene.

According to an embodiment of the application, said *Y. pseudotuberculosis* cell is attenuated:
- by partial or complete deletion of at least one of the yopK and the psaA genes, still more particularly
- by partial or complete deletion of at least one of the HPI genes, still more particularly
- by partial or complete deletion of at least one HPI gene, which is a YPTB gene, still more particularly
- by partial or complete deletion of at least the HPI genes YPTB1585 to YPTB1602 (YPTB genes as identified in the *Y. pseudotuberculosis* strain IP32953, the genome sequence of which is available under NC_006155 (SEQ ID NO: 19), more particularly under NC_006155.1 (SEQ ID NO: 19)), still more particularly
- by partial or complete deletion of a number of HPI genes that is sufficient to attenuate the HPI-induced virulence, still more particularly
- by partial or complete deletion of all the HPI genes, still more particularly
- by partial or complete deletion of at least one of the yopK and the psaA genes and by partial or complete deletion of at least one, at least two or all of the HPI genes, or at least from YPTB1585 to YPTB1602, still more particularly
- by partial or complete deletion of at least one of the yopK and the psaA genes and by partial or complete deletion of at least from YPTB1585 to YPTB1602, still more particularly
- by partial or complete deletion of the yopK and the psaA genes and by partial or complete deletion of at least one, at least two or all of the HPI genes;
- by partial or complete deletion of the yopK and the psaA genes and by partial or complete deletion of at least from YPTB1585 to YPTB1602

According to an embodiment of the application, said *Y. pseudotuberculosis* cell is attenuated by partial or complete deletion of the HPI genes YPTB1585 to YPTB1602, of the yopK gene and of the psaA gene, still more particularly by partial deletion of the HPI genes, of the yopK gene and of the psaA gene.

Illustrative *Y. pseudotuberculosis* HPI gene sequences are available and identified in the genome sequence of *Y. pseudotuberculosis* strain IP32953 (genome sequence NC_006155 (SEQ ID NO: 19), more particularly NC_006155.1 (SEQ ID NO: 19)). For example, the YPTB1585 through YPTB1602 sequences extend from position 1,914,026 to position 1,949,600 of said genome sequence.

An illustrative *Y. pseudotuberculosis* yopK gene sequence is available and identified in the pYV plasmid sequence of *Y. pseudotuberculosis* IP32953 (plasmid sequence NC_006153, more particularly NC_006153.2). For example, the yopK sequence extends from position 28,491 to position 29,039 of said *Y. pseudotuberculosis* plasmid sequence (complement sequence).

An illustrative *Y. pseudotuberculosis* psaA gene sequence is available and identified in the genome sequence of *Y. pseudotuberculosis* strain IP32953 (genome sequence NC_006155 (SEQ ID NO: 19), more particularly NC_006155.1 (SEQ ID NO: 19)). For example, the psaA sequence extends from position 1,588,872 to position 1,589,348 of said genome sequence.

According to an alternative or complementary embodiment of the application, said *Y. pseudotuberculosis* cell is strongly attenuated, e.g., its $LD_{50}$ for mice is higher than $10^{10}$ CFU via the oral route.

Said *Y. pseudotuberculosis* cell can be a killed cell or a live cell.

According to an advantageous embodiment of the application, said *Y. pseudotuberculosis* cell is a live cell. According to an advantageous embodiment of the application, said *Y. pseudotuberculosis* cell has retained the capacity of in vitro and/or in vivo replication, e.g., in vitro replication on a culture medium such as the Luria Bertani Broth (LB) medium and/or in vivo replication in a non-human mammal such as a mouse or in a human.

The *Y. pseudotuberculosis* cell of the application comprises nucleic acid coding for at least one *Yersinia pestis* Caf1 polypeptide or for at least one antigenic fragment of *Y. pestis* Caf1.

More particularly, the *Y. pseudotuberculosis* cell of the application comprises nucleic acid coding for surface-expression of at least one *Yersinia pestis* Caf1 polypeptide or for surface-expression of at least one antigenic fragment of *Y. pestis* Caf1.

*Yersinia pestis* Caf1 is a polypeptide that is expressed by naturally-occurring *Y. pestis* cells.

*Y. pestis* Caf1 is the monomer subunit that forms the major component of the pathogen capsule, i.e., the *Y. pestis* fraction 1 antigen (F1).

*Y. pestis* F1 is known to be involved in *Y. pestis* resistance to phagocytosis.

The naturally-occurring biogenesis process follows a chaperone/usher pathway, according to which *Y. pestis* Caf1 polypeptides are transported from the inner membrane to the outer membrane, and are assembled in oligomeric form at the bacterial surface, whereby forming the F1 protein.

In the periplasm, a chaperone protein (Caf1M) binds to a Caf1 polypeptide and transport it to the outer membrane. The chaperone:Caf1 complexes are then targeted to the usher (Caf1A), located in the outer membrane, where the Caf1 signal peptide is cleaved and where the mature Caf1 polypeptides are joined together to form a growing chain, which is subsequently translocated through the outer membrane to the surface of the bacteria.

The Caf1 monomer has a molecular weight (MW) of about 17.6 kDa before cleavage of the signal peptide.

After cleavage of the signal peptide sequence, the mature Caf1 monomer has a MW of about 15.5-16.5 kDa. The calculated pI is of about 4.3.

The Caf1 oligomer that is formed at the bacterial surface generally has a MW higher than 1,000 kDa.

*Y. pestis* can be classified into at least three biotypes [Antigua (A), Medievalis (M) or Orientalis (O)] on the basis of their ability to use glycerol and to reduce nitrate.

In the application, *Y. pestis* can be of any biotype, e.g., of the A biotype, or of the M biotype or of the O biotype, for example of the M or O biotype, more particularly of the O biotype.

*Y. pestis* strains are available to the person of ordinary skill in the art, e.g., from collections of microorganisms, from commercial sources or by isolation from a contaminated organism (e.g., from an infected human or from an infected non-human animal or mammal or from an infected insect such as an infected flea).

Illustrative *Y. pestis* e.g. comprise:
the CO92 strain (O biotype);
the KIM10+ strain (M biotype);
the *Y. pestis* strain that is available from NCTC under n° NCTC 5923;
the *Y. pestis* strain that is available from NCTC under n° NCTC 2868;
the *Y. pestis* strain that is available from NCTC under n° NCTC 10329;
the *Y. pestis* strain that is available from NCTC under n° NCTC 10330;

Means for cloning the caf1 gene (and/or for cloning the caf operon) from *Y. pestis* cells are known and available to the person of average skill in the art. Such means e.g., comprise those described in the examples below.

An illustrative *Y. pestis* Caf1 sequence is:
the sequence that is available under accession number P26948 (170 amino acids), which comprises the Caf1 signal peptide (first 21 N-terminal amino acids) and the mature Caf1 (amino acids 22-170), i.e., the sequence of SEQ ID NO: 10, which is:

MKKISSVIAIALFGTIATANAADLTASTTATATLVEPARITLTYKEG

APITIMDNGNIDTELLVGTLTLGGYKTGTTSTSVNFTDAAGDPMYLT

FTSQDGNNHQFTTKVIGKDSRDFDISPKVNGENLVGDDVVLATGSQD

FFVRSIGSKGGKLAAGKYTDAVTVTVSNQ;

or
the corresponding mature Caf1 protein sequence, i.e., the sequence of SEQ ID NO: 12, which is SEQ ID NO: 10 deleted from the peptide signal sequence, i.e.:

ADLTASTTATATLVEPARITLTYKEGAPITIMDNGNIDTELLVGTLT

LGGYKTGTTSTSVNFTDAAGDPMYLTFTSQDGNNHQFTTKVIGKDSR

DFDISPKVNGENLVGDDVVLATGSQDFFVRSIGSKGGKLAAGKYTDA

VTVTVSNQ.

An illustrative sequence coding for *Y. pestis* Caf1 is available and identified in the *Y. pestis* caf operon (operon sequence X61996.1). For example, the caf1 sequence extends from position 4618 to position 5130 of said *Y. pestis* caf operon sequence.) i.e., the sequence of SEQ ID NO: 9 (which codes for the sequence of SEQ ID NO: 10), which is:

ATGAAAAAAATCAGTTCCGTTATCGCCATTGCATTATTTGGAACTAT

TGCAACTGCTAATGCGGCAGATTTAACTGCAAGCACCACTGCAACGG

CAACTCTTGTTGAACCAGCCCGCATCACTCTTACATATAAGGAAGGC

GCTCCAATTACAATTATGGACAATGGAAACATCGATACAGAATTACT

TGTTGGTACGCTTACTCTTGGCGGCTATAAAACAGGAACCACTAGCA

CATCTGTTAACTTTACAGATGCCGCGGGTGATCCCATGTACTTAACA

TTTACTTCTCAGGATGGAAATAACCACCAATTCACTACAAAAGTGAT

TGGCAAGGATTCTAGAGATTTTGATATCTCTCCTAAGGTAAACGGTG

AGAACCTTGTGGGGGATGACGTCGTCTTGGCTACGGGCAGCCAGGAT

TTCTTTGTTCGCTCAATTGGTTCCAAAGGCGGTAAACTTGCAGCAGG

TAAATACACTGATGCTGTAACCGTAACCGTATCTAACCAATAA;

or the sequence of SEQ ID NO: 11 (which codes for the sequence of SEQ ID NO: 12), which is the sequence of SEQ ID NO: 9 deleted from the signal peptide sequence, i.e.:

GCAGATTTAACTGCAAGCACCACTGCAACGGCAACTCTTGTTGAACC

AGCCCGCATCACTCTTACATATAAGGAAGGCGCTCCAATTACAATTA

TGGACAATGGAAACATCGATACAGAATTACTTGTTGGTACGCTTACT

CTTGGCGGCTATAAAACAGGAACCACTAGCACATCTGTTAACTTTAC

AGATGCCGCGGGTGATCCCATGTACTTAACATTTACTTCTCAGGATG

GAAATAACCACCAATTCACTACAAAAGTGATTGGCAAGGATTCTAGA

GATTTTGATATCTCTCCTAAGGTAAACGGTGAGAACCTTGTGGGGGA

TGACGTCGTCTTGGCTACGGGCAGCCAGGATTTCTTTGTTCGCTCAA

TTGGTTCCAAAGGCGGTAAACTTGCAGCAGGTAAATACACTGATGCT

GTAACCGTAACCGTATCTAACCAATAA.

Antigenic fragments of said *Y. pestis* Caf1 notably comprise those Caf1 fragments, which have retained the ability to induce or stimulate a cell-mediated immune response in a human or in a non-human mammal, more particularly the ability to induce or stimulate T cells in a human or in a non-human mammal.

Antigenic fragments of said *Y. pestis* Caf1 also comprise those Caf1 fragments, which show said ability when coupled to an immunogenicity carrier, such as keyhole limpet hemocyanin, horseshoe crab hemocyanin, bovine serum albumin.

Said nucleic acid, which codes for at least one *Yersinia pestis* Caf1 polypeptide and its export machinery or for at least one antigenic fragment of *Y. pestis* Caf1, is comprised in (more particularly, has been inserted in or integrated into) the chromosome of said *Y. pseudotuberculosis* cell, more particularly in the chromosomal DNA of said *Y. pseudotuberculosis* cell.

According to an embodiment of the application, said nucleic acid is stably comprised in (more particularly, inserted in or integrated into) said chromosome or chromosomal DNA.

According to an embodiment of the application, said nucleic acid is irreversibly comprised in (more particularly, inserted in or integrated into) said chromosome or chromosomal DNA.

According to an embodiment of the application, said nucleic acid is stably and/or irreversibly comprised in (more particularly, inserted in or integrated into) said chromosome or chromosomal DNA.

Means for inserting or integrating said nucleic acid in the chromosome of said *Y. pseudotubercolisis* cell, more particularly for stably and/or irreversibly inserting or integrating said nucleic acid in the chromosome of said *Y. pseudotubercolisis* cell, are available to the person of ordinary skill in the art.

Illustrative means comprise:
retroviral integration means;
transposon means.

Advantageously, said means are transposon means, more particularly DNA transposon means, more particularly mini-transposon means, still more particularly Tn7 mini-transposon means.

Illustrative transposon means comprise a carrier or delivery plasmid, wherein the nucleic acid to be transposed is inserted between the transposon ends (e.g., between Tn7L and Tn7R, which are the ends of the Tn7 mini-transposon). Illustrative transposon means may further comprise a helper plasmid, which carries transposase genes (e.g., the Tn7 transposes genes tnsABCDE), for insertion of the transposon in the target chromosome.

Figure 1:
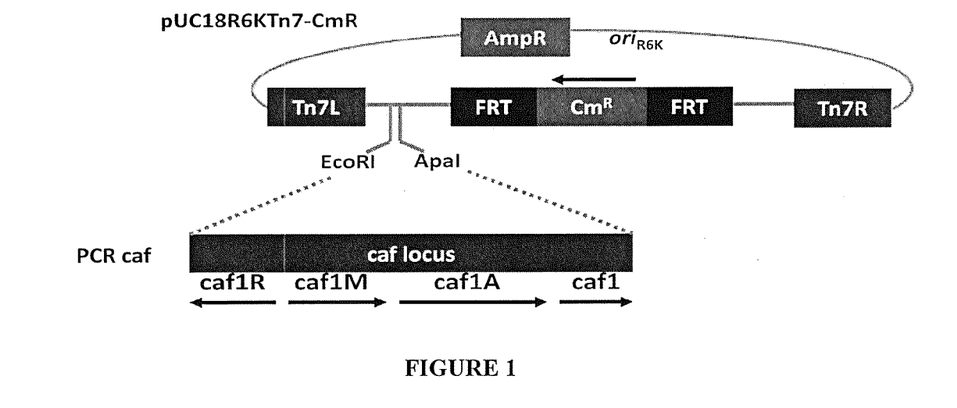
FIG. 1: Genetic map of the recombinant plasmid pUC18R6KTn7-caf-Cm$^R$, which carries the caf operon [caf1M, caf1A and caf1 (under the control of caf1R as regulatory sequence)] inserted in the Tn7 mini-transposon.
Figure 2:
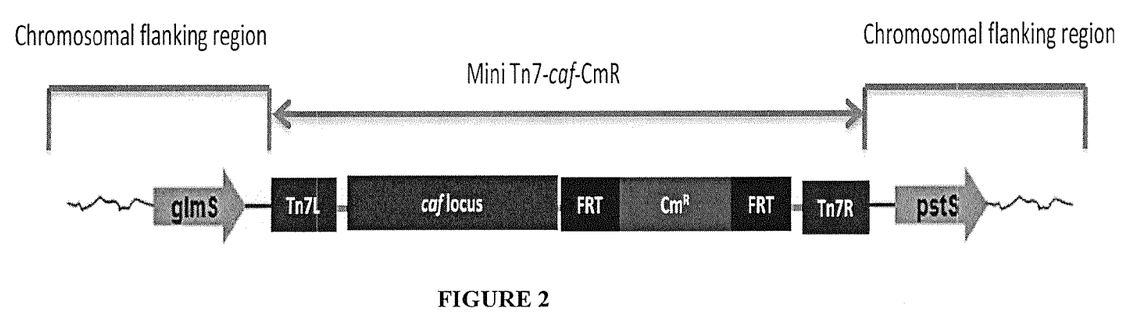
FIG. 2: Genetic map of the mini Tn7-caf-Cm$^R$ transposon integrated into the chromosome of an attenuated *Y. pseudotuberculosis* strain.

Illustrative transposon means are e.g., as described:
in bibliographic reference (2), i.e., Choi et al. 2005, and/or
in the examples below, and/or
in FIG. 1, and/or
in FIG. 2, and/or
in bibliographic reference (10), i.e., Grinter 1983, and/or
in bibliographic reference (11), i.e., Barry et al. 1986, and/or
in bibliographic reference (12), i.e., Bao et al. 1991, and/or
in bibliographic reference (13), i.e., Højberg et al. 1999, and/or
in bibliographic reference (14), i.e., Koch et al. 2001.

According to an advantageous embodiment of the application, said nucleic acid, which codes for at least one *Yersinia pestis* Caf1 polypeptide or for at least one antigenic fragment of *Y. pestis* Caf1, has been inserted in or integrated into the chromosome of said *Y. pseudotuberculosis* cell, more particularly in the chromosomal DNA of said *Y. pseudotuberculosis* cell, by nucleic acid transposition.

According to an advantageous embodiment of the application, at least one transposon carrying the caf operon is integrated in the chromosome of said *Y. pseudotuberculosis* cell.

According to an advantageous embodiment of the application, the chromosome of the *Y. pseudotuberculosis* cell comprises said coding nucleic (e.g., the *Y. pestis* operon encoding the F1 protein or capsule) and two transposon ends (e.g., Tn7L and Tn7R, which are the ends of the Tn7 transposon and of the Tn7 mini-transposon).

The nucleic acid, which codes for said at least one *Y. pestis* Caf1 polypeptide (e.g., the *Y. pestis* operon encoding the F1 protein or capsule) or for said at least one antigenic fragment of *Y. pestis* Caf1, can e.g., be inserted into the chromosome of an attenuated *Y. pseudotuberculosis* strain, e.g., as described above and in the examples and/or figures below.

According to an embodiment of the application, said nucleic acid, which codes for at least one *Y. pestis* Caf1 polypeptide or for at least one antigenic fragment of *Y. pestis* Caf1, is a nucleic acid that codes for expression of said at least one *Y. pestis* Caf1 polypeptide or of said at least one antigenic fragment of *Y. pestis* Caf1 at the surface of said genetically attenuated *Y. pseudotuberculosis* cell.

Said at least one surface-expressed *Y. pestis* Caf1 polypeptide can be contained in an oligomer, more particularly in an oligomer essentially consisting of *Y. pestis* Caf1 monomers.

Advantageously, said oligomer is the *Y. pestis* F1 protein.

Hence, said at least one surface-expressed *Y. pestis* Caf1 polypeptide can e.g., be contained in or expressed in the form of a *Y. pestis* F1 protein.

Said at least one surface-expressed *Y. pestis* Caf1 polypeptide can e.g., be expressed as a component of a capsule surrounding said *Y. pseudotuberculosis* cell.

According to an embodiment of the application, said *Y. pseudotuberculosis* cell expresses or can express the *Y. pestis* F1 protein at its surface.

According to an embodiment of the application, said *Y. pseudotuberculosis* cell expresses or can express the *Y. pestis* capsule, i.e., the *Y. pestis* F1 capsule.

According to an embodiment of the application, said *Y. pseudotuberculosis* cell is encapsulated.

According to an embodiment of the application, said *Y. pseudotuberculosis* cell is surrounded by the *Y. pestis* capsule or by components thereof.

According to an embodiment of the application, said *Y. pseudotuberculosis* cell is recognized (i.e., bound) by an anti-*Y. pestis* F1 monoclonal antibody, more particularly specifically recognized (i.e., bound) by an anti-*Y. pestis* F1 monoclonal antibody (e.g., the monoclonal antibody described in Chanteau et al. 2003 [bibliographic reference 3] or the monoclonal antibody available from QED Bioscience, Inc.; 10919 Technology Place, Suite C; U.S.A.; under catalog n° 18740 (YBF19)).

According to an embodiment of the application, said nucleic acid coding for said at least one *Y. pestis* Caf1 polypeptide or for said at least one antigenic fragment of *Y. pestis* Caf1 (e.g., for at least one *Y. pestis* F1 protein, or for a *Y. pestis* capsule) further comprises one or more gene(s), more particularly one or more structural gene(s):

for expression of said at least one *Y. pestis* Caf1 polypeptide or for said at least one antigenic fragment of *Y. pestis* Caf1 (e.g., for at least one *Y. pestis* F1 protein, or for an *Y. pestis* capsule) in accordance with a chaperone/usher pathway; and/or for surface-expression of said at least one *Y. pestis* Caf1 polypeptide or for said at least one antigenic fragment of *Y. pestis* Caf1 (e.g., for at least one *Y. pestis* F1 protein, or for an *Y. pestis* capsule), more particularly for expression at the surface of said *Y. pseudotuberculosis* cell.

Such further gene(s) can e.g., be:
at least one gene coding for a protein that can act as a chaperone for said at least one *Y. pestis* Caf1 or antigenic Caf1 fragment, such as the *Y. pestis* Caf1M, and/or, more particularly and
at least of gene coding for a protein that can act as a usher for said at least one *Y. pestis* Caf1 or antigenic Caf1 fragment, such as the *Y. pestis* Caf1A.

Alternatively or complementarily, said nucleic acid coding for said at least one *Y. pestis* Caf1 polypeptide or for said at least one antigenic fragment of *Y. pestis* Caf1 (e.g., for at least one *Y. pestis* F1 protein, or for an *Y. pestis* capsule) further comprises at least one regulatory sequence, such as the *Y. pestis* caf1R regulatory sequence, which controls the expression of at least one *Y. pestis* Caf1 polypeptide or for said at least one antigenic fragment of *Y. pestis* Caf1 (e.g., for at least one *Y. pestis* F1 protein, or for an *Y. pestis* capsule) and/or the expression of said further gene(s).

According to an embodiment of the application, said nucleic acid coding for said at least one *Y. pestis* Caf1 polypeptide or for said at least one antigenic fragment of *Y. pestis* Caf1 (e.g., for at least one *Y. pestis* F1 protein, or for an *Y. pestis* capsule) is an operon.

Said operon advantageously comprises said further gene(s) and/or said at least one regulatory sequence, more particularly said further gene(s) and said at least one regulatory sequence.

Said operon may e.g., comprise at least one gene coding for (at least one) *Y. pestis* Caf1 or at least one antigenic Caf1 fragment, more particularly for (at least one) *Y. pestis* Caf1, and:
- at least one gene coding for a protein that can act as a chaperone for said *Y. pestis* Caf1, such as the *Y. pestis* Caf1M, and/or, more particularly and
- at least of gene coding for a protein that can act as a usher for said *Y. pestis* Caf1, such as the *Y. pestis* Caf1A.

For example, said operon advantageously comprises at least one gene coding for *Y. pestis* Caf1, at least one gene coding for the *Y. pestis* Caf1M chaperone protein and at least one gene coding for the *Y. pestis* Caf1A usher protein.

Said operon may further comprise a regulatory sequence, such as the *Y. pestis* caf1R regulatory sequence, to control the expression of said gene(s).

An illustrative operon is contained in the pMT1 plasmid (accession number AL117211; 96,210 bp) from *Y. pestis* strain CO92, which (inter alia) encodes the *Y. pestis* F1 protein.

An illustrative *Y. pestis* Caf1M protein sequence is the sequence under accession number P26926 (258 amino acids), i.e., the sequence of SEQ ID NO: 14, which is:

MILNRLSTLGIITFGMLSFAANSAQPDIKFASKEYGVTIGESRIIYP

LDAAGVMVSVKNTQDYPVLIQSRIYDENKEKESEDPFVVTPPLFRLD

AKQQNSLRIAQAGGVFPRDKESLKWLCVKGIPPKDEDIWVDDATNKQ

KFNPDKDVGVFVQFAINNCIKLLVRPNELKGTPIQFAEKLSWKVDGG

KLIAENPSPFYMNIGELTFGGKSIPSHYIPPKSTWAFDLPKGLAGAR

NVSWRIINDQGGLDRLYSKNVTL.

An illustrative sequence coding for an *Y. pestis* Caf1M protein is the sequence of SEQ ID NO: 13 [CDS (AL117211.1:82567 . . . 83343)], which is:

ATGATTTTAAATAGATTAAGTACGTTAGGAATTATTACTTTCGGCAT

GCTTAGTTTTGCTGCGAACTCTGCTCAACCAGATATCAAATTCGCAA

GCAAAGAGTATGGCGTGACTATAGGTGAGAGTAGGATCATATACCCG

TTAGATGCTGCTGGCGTTATGGTCTCGGTGAAAAACACCCAAGATTA

TCCGGTTCTCATTCAGTCTAGGATCTACGACGAGAATAAAGAAAAAG

AATCAGAGGATCCTTTCGTGGTCACTCCGCCATTGTTTCGATTGGAT

GCTAAGCAACAAAATTCTTTGCGTATAGCTCAGGCTGGAGGTGTTTT

CCCGCGAGATAAAGAGAGCCTAAAGTGGTTATGCGTAAAAGGGATTC

CACCAAAGGATGAAGATATATGGGTTGATGATGCGACAAATAAGCAA

AAATTCAATCCAGACAAAGATGTGGGAGTGTTCGTGCAATTCGCAAT

TAATAATTGCATTAAGCTTTTGGTTCGACCGAATGAATTAAAAGGAA

CCCCTATACAGTTTGCTGAAAACTTAAGCTGGAAAGTTGATGGGGGG

AAGCTAATTGCTGAAAACCCCTCACCTTTCTACATGAACATAGGTGA

ATTAACATTTGGAGGGAAAAGTATTCCTTCTCACTATATTCCACCTA

AATCGACGTGGGCTTTTGATTTGCCAAAAGGACTAGCGGGAGCACGT

AATGTTTCGTGGAGAATAATTAATGATCAGGGAGGGTTGGATCGTTT

GTATTCCAAAAATGTGACTTTATGA.

An illustrative *Y. pestis* Caf1A protein sequence is the sequence under accession number P26949 (833 amino acids), i.e., the sequence of SEQ ID NO: 16, which is:

MRYSKLFLCAGLTLATLPCWGRAYTFDSTMLDTNSGESIDVSLFNQG

LQLPGNYFVNVFVNGRKVDSGNIDFRLEKHNGKELLWPCLSSLQLTK

YGIDIDKYPDLIKSGTEQCVDLLAIPHSDVQFYFNQQKLSLIVPPQA

LLPRFDGIMPMQLWDDGIPALFMNYNTNMQTRKFREGGKSLDSYYAQ

LQPGLNIGAWRFRSSTSWWKQQGWQRSYIYAERGLNTIKSRLTLGET

YSDSSIFDSIPIKGIKIASDESMVPYYQWNFAPVVRGIARTQARVEV

LRDGYTVSNELVPSGPFELANLPLGGGSGELKVIIHESDGTKQVFTV

PYDTPAVALRKGYFEYSMMGGEYRPANDLTQTSYVGVFGMKYGLPRN

FTLYGGLQGSQNYHAEALGIGAMLGDFGAISTDVTQADSQKNKQKKE

SGQRWRVRYNKYLQSGTSLNIASEEYATEGFNKLADTLNTYCKPNTR

NDCRFDYAKPKNKVQFNLSQSIPGSGTLNFSGYRKNYWRDSRSTTSF

SVGYNHFFRNGMSLTLNLSKTQNINKYGEKTSELLSNIWLSFPLSRW

LGNNSINSNYQMTSDSHGNTTHEVGVYGEAFDRQLYWDVRERFNEKG

RKYTSNALNLNYRGTYGEISGNYSYDQTQSQLGIGVNGNMVITQYGI

TAGQKTGDTIALVQAPDISGASVGYWPGMKTDFRGYTNYGYLTPYRE

YKVEINPVTLPNDAEITNNIVSVIPTKGAVVLAKFNARIGGRLFLHL

KRSDNKPVPFGSIVTIEGQSSSSGIVGDNSGVYLTGLPKKSKILVKW

GRDKNQSCSSNVVLPEKTDISGAYRLSTTCILNN.

An illustrative sequence coding for an *Y. pestis* Caf1A protein is the sequence of SEQ ID NO: 15 [CDS (AL117211.1:83368 . . . 85869)], which is:

ATGAGGTATTCAAAGCTGTTCCTGTGTGCAGGGTTAACTTTGGCAAC

ATTGCCTTGTTGGGGACGCGCATATACTTTTGACTCTACTATGCTTG

ATACGAATAGTGGAGAGATATAGATGTATCTCTTTTTAATCAAGGA

CTTCAACTTCCAGGTAATTATTTTGTTAATGTTTTTGTAAATGGTCG

AAAGGTAGACTCTGGAAATATCGACTTCCGTCTAGAAAAACATAATG

GAAAAGAACTTCTTTGGCCATGCCTATCATCCTTACAATTGACAAAG

TATGGCATTGATATAGATAAATATCCTGATTTAATAAAATCTGGTAC

AGAGCAATGTGTTGATTTATTAGCAATACCACATTCAGATGTGCAGT

TTTATTTTAATCAGCAGAAATTATCGTTAATTGTGCCACCACAGGCA

-continued
CTTTTACCTAGATTTGATGGCATTATGCCAATGCAATTGTGGGATGA

CGGCATTCCTGCTCTGTTCATGAATTATAATACGAACATGCAGACAA

GAAAATTCAGAGAAGGAGGCAAGTCTCTGGACTCTTATTATGCTCAG

TTGCAACCGGGATTAAACATAGGGGCTTGGCGCTTTCGTAGTTCAAC

CTCATGGTGGAAACAACAAGGATGGCAGCGTTCGTATATTTATGCCG

AGCGAGGATTGAATACAATTAAGAGCCGTTTGACATTGGGGGAAACC

TATTCTGATAGCAGTATCTTTGACAGTATCCCGATTAAGGGGATAAA

AATTGCTTCAGATGAATCGATGGTTCCTTATTACCAATGGAATTTTG

CTCCAGTTGTTCGCGGTATCGCACGTACACAAGCCAGGGTAGAGGTT

TTAAGAGATGGCTACACTGTAAGTAATGAGTTGGTGCCCTCGGGACC

ATTTGAGTTAGCAAATCTTCCTCTGGGTGGGGGGAGTGGTGAGCTGA

AAGTCATCATTCATGAAAGTGATGGAACAAAGCAAGTTTTTACAGTT

CCATATGACACACCAGCAGTGGCATTACGGAAGGGCTATTTCGAATA

TTCAATGATGGGGGGAGAATATCGTCCAGCTAATGATCTTACACAAA

CATCGTATGTTGGCGCTCTTGGGATGAAATATGGTTTGCCAAGGAAT

CTTACGTTATATGGTGGACTACAAGGGTCCCAAAATTATCATGCCGC

AGCTCTGGGTATCGGTGCTATGTTGGGTGATTTTGGTGCCATATCTA

CAGATGTTACTCAAGCAGACAGCCAGAAAATAAACAAAAAAAGAA

AGCGGCCAACGTTGGCGCGTTCGTATATAAGTACTTGCAGAGTGG

AACATCGTTAAACATTGCTAGCGAGGAATACGCCACAGAAGGATTTA

ACAAACTCGCTGACACGTTAAATACTTATTGTAAACCTAATACTAGA

AACGATTGCCGTTTTGATTATGCTAAACCCAAAACAAAGTGCAATT

CAATTTAAGTCAAAGCATACCTGGTTCGGGGACGCTTAATTTCAGTG

GCTACAGAAAAAACTATTGGCGTGACAGTAGGAGCACAACTTCTTTT

TCTGTAGGCTATAACCATTTTTTTAGGAATGGTATGTCATTGACTTT

AAATTTATCGAAGACACAGAATATCAATAAGTATGGAGAAAAAACTA

GTGAGCTATTATCTAATATCTGGTTGAGTTTTCCTCTCAGTCGCTGG

CTAGGTAATAACTCAATAAATTCAAATTACCAAATGACATCAGATTC

TCATGGTAACACTACCCATGAGGTAGGTGTGTACGGTGAAGCCTTTG

ATCGCCAATTATACTGGGACGTTCGCGAACGTTTTAATGAAAAGGGC

AGAAAATATACCTCCAATGCACTGAATTTGAATTATCGAGGAACTTA

TGGGGAGATCAGTGGTAACTACAGCTACGATCAAACCCAAAGCCAAC

TTGGTATAGGTGTAAATGGCAATATGGTAATAACTCAGTACGGTATA

ACGGCTGGCCAAAAAACTGGAGATACTATTGCATTAGTACAAGCCCC

TGATATAAGCGGTGCTTCAGTGGGATACTGGCCAGGCATGAAAACAG

ACTTTAGGGGGTACACCAATTATGGTTACTTAACCCCTTACAGAGAG

AATAAGGTAGAAATTAACCCAGTTACTTTACCCAATGATGCAGAGAT

AACAAATAATATTGTTAGCGTGATCCCGACAAAGGGAGCTGTAGTAT

TAGCAAAATTTAACGCAAGGATTGGTGGACGATTGTTTTTACATTTA

AAACGCTCTGACAATAAACCTGTTCCATTTGGTTCTATAGTTACCAT

TGAAGGGCAATCATCCAGCTCTGGCATTGTCGGAGATAATAGCGGTG

-continued
TCTATTTGACTGGACTACCTAAAAAATCAAAAATACTTGTTAAGTGG

GGGAGAGATAAAAATCAATCATGTTCATCTAATGTAGTTCTACCAGA

AAAAACGGATATTTCTGGTGCTTATAGGTTATCCACAACCTGCATCT

TAAATAACTGA.

An illustrative Y. pestis Caf1R protein sequence is the sequence under accession number P26950 (301 amino acids), i.e., the sequence of SEQ ID NO: 18, which is:

MLKQMTVNSIIQYIEENLESKFINIDCLVLYSGFSRRYLQISFKEYV

GMPIGTYIRVRRASRAAALLRLTRLTHEISAKLFYDSQQTFTREFKK

IFGYTPRQYRMIPFWSFKGLLGRREINCEYLQPRICYLKERNIIGQC

FNFRDLVFYSGIDSKCRLGKLYDSLKKNTAITVSNRIPFHDKTNDII

ARTVVWDRNKHFSDSEIKVDKGLYAYFFFNDTYDQYVHHMYNIYYNS

LPIYNLNKRDGYDVEVIKRRNDNTIDCHYFLPIYCDDMEFYNEMQVY

HNNIVKPEMSVTLGLPKS.

An illustrative sequence coding for an Y. pestis Caf1R protein is the sequence of SEQ ID NO: 17 [complement (AL117211.1:81352 ... 82257)], which is:

ATGCTAAAACAGATGACTGTAAATTCAATTATTCAATATATAGAAGA

GAATCTCGAGTCGAAATTCATTAACATTGACTGTTTGGTTTTGTATT

CAGGATTCAGCAGAAGGTATTTGCAAATTTCCTTTAAGGAATATGTC

GGAATGCCTATTGGAACATATATTAGAGTTAGAAGGGCTAGTAGAGC

TGCTGCACTATTACGGCTTACCAGGCTGACAATAATAGAGATATCAG

CAAAGCTTTTTTATGATTCGCAACAGACATTCACCAGAGAATTTAAG

AAAATATTTGGTTATACCCCACGGCAGTATAGGATGATCCCTTTTTG

GTCCTTTAAAGGTTTGTTGGGTAGAAGGGAAATTAACTGTGAATACC

TTCAACCACGAATCTGTTACCTTAAAGAGAGAAATATAATTGGTCAA

TGCTTTAATTTTAGGGATTTAGTGTTCTACTCTGGGATAGATTCAAA

ATGTAGATTGGGTAAGTTATATGATTCGTTGAAGAAAAATACAGCTA

TAACAGTATCAAACAGAATCCCCTTTCATGATAAAACGAATGACATT

ATTGCAAGAACGGTTGTTTGGGATAGGAATAAGCATTTCAGCGATAG

TGAAATAAAGGTAGATAAAGGCCTGTATGCTTATTTTTTCTTCAATG

ATACATATGATCAGTATGTTCATCACATGTACAACATATATTATAAC

TCTTTGCCTATTTATAATTTAAATAAGCGGGATGGTTACGATGTGGA

GGTCATAAAAAGACGAAATGACAATACTATTGATTGTCATTATTTTC

TCCCGATTTATTGTGATGACATGGAGTTTTACAATGAAATGCAGGTA

TATCACAATAATATTGTGAAGCCGGAAATGTCAGTAACATTAGGATT

ACCAAAGAGTTAA.

According to an embodiment, said nucleic acid comprises at least one gene coding for (at least one) Y. pestis Caf1 or at least one antigenic Caf1 fragment, more particularly for (at least one) Y. pestis Caf1, and (e.g., organized in an operon):

at least one gene coding for the *Y. pestis* Caf1M protein of SEQ ID NO: 14, e.g., the *Y. pestis* caf1M nucleic acid of SEQ ID NO: 13, and/or, more particularly and at least of gene coding for the *Y. pestis* Caf1A protein of SEQ ID NO: 16, e.g., the *Y. pestis* caf1A nucleic acid of SEQ ID NO: 15.

According to an embodiment, said nucleic acid comprises at least one gene coding for (at least one) *Y. pestis* Caf1 or at least one antigenic Caf1 fragment, more particularly for (at least one) *Y. pestis* Caf1, and (e.g., organized in an operon):

at least one gene coding for the *Y. pestis* Caf1M protein of SEQ ID NO: 14, e.g., the *Y. pestis* caf1M nucleic acid of SEQ ID NO: 13, and/or, more particularly and at least of gene coding for the *Y. pestis* Caf1A protein of SEQ ID NO: 16, e.g., the *Y. pestis* caf1A nucleic acid of SEQ ID NO: 15, and/or, more particularly and at least of gene coding for the *Y. pestis* Caf1R protein of SEQ ID NO: 18, e.g., the *Y. pestis* caf1R nucleic acid of SEQ ID NO: 17.

According to an embodiment, the application relates to an avirulent *Yersinia pseudotuberculosis* cell, more particularly to a genetically attenuated *Yersinia pseudotuberculosis* cell, which derives from a *Y. pseudotuberculosis* cell, more particularly from a cell of *Y. pseudotuberculosis* strain IP32953 (the chromosomal sequence of which is the sequence available under accession number NC_006155 (SEQ ID NO: 19)), by:

deletion or inactivation of one or more genes selected from HPI, yopK and psaA (as above described and/or below illustrated) and by chromosomal insertion of said nucleic acid coding for the expression of at least one *Yersinia pestis* Caf1 polypeptide or antigenic fragment at the surface of said *Y. pseudotuberculosis* cell (as above described and/or below illustrated).

The application also relates to a plurality of cells, which comprises at least one *Yersinia pseudotuberculosis* cell of the application, as well as to a *Yersinia pseudotuberculosis* strain, which comprises at least one cell of the application, or which consists or essentially consists of cells of the application.

The application also relates to said *Yersinia pseudotuberculosis* strain, wherein more than 50%, more particularly more than 55%, still more particularly more than 60%, still of more particularly more than 65%, still of more particularly more than 70%, still of more particularly more than 75%, still of more particularly more than 80%, still of more particularly more than 85%, still of more particularly more than 90%, still of more particularly more than 95% of the cells of said strain are encapsulated by a *Y. pestis* pseudo capsule.

Said *Y. pseudotuberculosis* strain advantageously is an avirulent *Y. pseudotubercolis* strain as herein described and/or illustrated. Said *Y. pseudotuberculosis* strain may consist or essentially consist of cells of the application.

The application also relates to said cell, said plurality of cells and to said strains, for use as an immunogen, more particularly for use as an immunogen against plague, still more particularly against bulbonic plague and/or pulmonary plague, still more particularly against bulbonic plague or pulmonary plague, still more particularly against bulbonic plague and pulmonary plague.

In the application, said nucleic acid or operon, which codes for said at least one *Y. pestis* Caf1 polypeptide (e.g., for the *Y. pestis* F1 protein or capsule) or for said at least one antigenic fragment of *Y. pestis* Caf1, more particularly said nucleic acid or operon, which codes for surface expression thereof, is inserted in (or integrated into) the chromosome of *Y. pseudotuberculosis*.

Chromosomal insertion of said nucleic acid or operon leads to unexpectedly higher levels of protection against both bubonic plague and pneumonic plague, more particularly against bubonic plague.

For example, a single oral inoculation of live, attenuated *Y. pseudotuberculosis*, in which the *Y. pestis* F1 operon has been inserted into the chromosome, can achieve:

100% protection against pneumonic plague after a challenge with $3,300 \times LD_{50}$ of *Y. pestis*, as well as 100% protection against bubonic plague after a challenge with $100 \times LD_{50}$ of *Y. pestis* [$LD_{50}$=50% lethal dose].

By comparison, when the *Y. pestis* F1 operon has not been inserted into the chromosome of *Y. pseudotuberculosis*, but is provided by a plasmid contained in *Y. pseudotuberculosis*, the vaccination protection is, under the same experimental conditions, of:

80% against pneumonic plague after a challenge with $3,300 \times LD_{50}$ of *Y. pestis*, and 81% against bubonic plague after a challenge with $100 \times LD_{50}$ of *Y. pestis*.

It is believed that the level of protection against bubonic plague and pneumonic plague that is achieved by the means of the application is one of the most, and probably the most efficient ever reported.

A cell of the application can be used with or without immunologic adjuvant, more particularly with an adjuvant, which accelerates, prolongs, or enhances the quality of immune responses to the *Y. pestis* polypeptide(s) or protein(s) that are expressed at the surface of the *Y. pseudotuberculosis* cell of the application.

Immunologic adjuvants are known to the person of ordinary skill in the art. Illustrative immunologic adjuvant comprises Freund's complete adjuvant, Freund's incomplete adjuvant, the Ribi adjuvant system, an adjuvant based on aluminium salts (e.g., alum) and/or liposomes, bacterial LPS.

Advantageously, a cell of the application can be used without immunologic adjuvant.

Said cell, said plurality of cells or said strain can be administered via any route that the person of ordinary skill in the art may find appropriate.

According to an embodiment of the application, said administration route is a non-invasive route, more particularly a route that does not require the use of any canula or other highly invasive instrument.

According to an embodiment of the application, said administration route is the oral route, the intranasal route, the subcutaneous route, the intradermal route, the intramuscular route.

According to an embodiment of the application, said administration route is a non-oral route, more particularly the intranasal route, the subcutaneous route, the intradermal route, the intramuscular route, more particularly the subcutaneous route.

According to an embodiment of the application, said cell, plurality of cells or strain is administered by spray (e.g., nasal and/or oral spray) and/or by injection (e.g., subcutaneous and/or intramuscular injection), more particularly by injection (e.g., subcutaneous and/or intramuscular injection), more particularly by subcutaneous injection.

Moreover, chromosomal insertion of said nucleic acid or operon may lead to particularly high vaccination efficacy, when the vaccination cells or strain is administered via routes other than the oral route, more particularly via a subcutaneous administration. Via such non-oral, lower doses are required to achieve the same vaccination efficacy and/or the same dose achieves protection against higher *Y. pestis* doses.

Said cell, said plurality of cells or said strain can be administered at any dose that the person of ordinary skill in the art may find appropriate, taking due account of the administration route contemplated and taking due account of the age, weight and health status of the intended recipient.

According to an embodiment of the application, said cell, plurality of cells or strain is administered at a dose sufficient to induce an immune response in the recipient organism, more particularly in a human or non-human animal or non-human mammal.

Said immune response can e.g., comprise a humoral response and/or a cell-mediated immune response, advantageously both a humoral response and a cell-mediated immune response.

According to an embodiment of the application, the dose at which said cell, plurality of cells or strain is administered is sufficient to induce both an immune response and a cell-mediated immune response at both the systemic level (e.g., IgG and Th1 cells) and the mucosal level (e.g., IgA and Th17 cells).

The application also relates to a composition, more particularly a pharmaceutical composition, still more particularly an immunogenic composition or vaccine, which comprises at least one of the following elements:
 at least one cell of the application,
 at least one plurality of cells of the application,
 at least one *Y. pseudotuberculosis* strain of the application.

According to an embodiment of the application, said composition, pharmaceutical composition, immunogenic composition or vaccine is a spray, a vial or a prefilled syringe, more particularly a vial or a prefilled syringe, more particularly a vial, more particularly a sealed vial suitable for storing an injectable product and for aseptically transferring said product from said vial into a syringe (e.g., a vial sealed by a septum or by a septum and a cap).

Said composition, more particularly a pharmaceutical composition, still more particularly an immunogenic composition or vaccine, may further comprise at least one pharmaceutically and/or physiologically acceptable vehicle (diluent, excipient, additive, pH adjuster, emulsifier or dispersing agent, preservative, surfactant, gelling agent, as well as buffering and other stabilizing and solubilizing agent, etc.), more particularly at least one vehicle suitable for vaccine administration to human or non-human animal or non-human mammal.

Appropriate pharmaceutically acceptable vehicles and formulations include all known pharmaceutically acceptable vehicles and formulations, such as those described in "Remington: The Science and Practice of Pharmacy", 20$^{th}$ edition, Mack Publishing Co.; and "Pharmaceutical Dosage Forms and Drug Delivery Systems", Ansel, Popovich and Allen Jr., Lippincott Williams and Wilkins.

In general, the nature of the vehicle will depend on the particular mode of administration being employed. For instance, parenteral formulations usually comprise, injectable fluids that include pharmaceutically and physiologically acceptable fluids, including water, physiological saline, balanced salt solutions, buffers, aqueous dextrose, glycerol, ethanol, sesame oil, combinations thereof, or the like as a vehicle. The medium also may contain conventional pharmaceutical adjunct materials such as, for example, pharmaceutically acceptable salts to adjust the osmotic pressure, buffers, preservatives and the like. The carrier and composition can be sterile, and the formulation suits the mode of administration.

A composition, pharmaceutical composition, immunogenic composition or vaccine of the application can e.g., be a liquid solution, suspension, emulsion, sustained release formulation, or powder.

Said composition, more particularly said pharmaceutical composition, still more particularly said immunogenic composition or vaccine, may further comprise an immunologic adjuvant, e.g., as above-described. However, an advantageous feature of the cell, plurality of cells and strain of the application is that such an adjuvant is not necessarily needed for induction of a protective effect.

The application also relates to a method of treatment of a subject in need thereof, e.g., a human, a non-human animal or a non-human mammal, which comprises administering to said subject at least one cell, plurality of cells or strain of the application, more particularly at a dose sufficient to induce an immune response as above-described.

The application relates to a method for preventing or treating *Y. pestis* infection in a mammal, which comprises administering to said mammal at least one avirulent *Yersinia pseudotuberculosis* cell, plurality of cells or strain of the application, more particularly at least one genetically attenuated *Yersinia pseudotuberculosis* cell, plurality of cells or strain of the application. Said at least one avirulent or genetically attenuated *Yersinia pseudotuberculosis* cell, plurality of cells or strain of the application can be administered to said mammal at a dose sufficient to induce an immune response as above-described, more particularly at a single unit dose. Said mammal can be a human or a non-human mammal, more particularly a human.

The application also relates to a method of administering an anti-plague immunogenic composition or vaccine, which comprises administering at least one cell, plurality of cells or strain of the application, or at least one composition, pharmaceutical composition, immunogenic composition or vaccine.

The cell, plurality of cells, strain(s), composition(s), pharmaceutical composition(s), immunogenic composition(s), vaccine(s) of the application are more particularly intended for administration to:
 a human, which is at risk to be in contact with or exposed to *Y. pestis*, more particularly to laboratory researchers, doctors, health therapists, people working in or for medical analysis laboratory, people working in or for the army or in a military environment;
 to a non-human animal, more particularly to a non-human mammal, more particularly a rodent, still more particularly to a rat or a mouse.

The application also relates to the use, more particularly to the in vitro use of a *Y. pseudotuberculosis* cell as a host cell for expression of at least one *Y. pestis* Caf1 polypeptide or of at least one antigenic fragment of *Y. pestis* Caf1, wherein nucleic acid coding for said at least one *Y. pestis* Caf1 polypeptide is comprised in the chromosome of said *Y. pseudotuberculosis* cell.

In the present application, CNCM means Collection Nationale de Cultures de Micro-organismes. The address of CNCM is: Collection Nationale de Cultures de Micro-organismes (CNCM); Institut Pasteur; 28, rue du Dr Roux; 75724 Paris Cedex 15; France.

In the present application, CRBIP means Biological Resource Center of Institut Pasteur. The address of CRBIP is: Institut Pasteur; Centre de Ressources Biologiques; 25-28 rue du Docteur Roux; 75015 Paris; France.

In the present application, NCTC means National Collection of Type Cultures. The address of NCTC is: Health Protection Agency Culture Collections; Health Protection Agency; Microbiology Services; Porton Down; Salisbury; SP4 OJG; United Kingdom.

In the present application, DSMZ means Deutsche Sammlung von Mikroorganismen and Zellkulturen GmbH. The address of DSMZ is: Leibniz Institute DSMZ—German Collection of Microorganisms and Cell Cultures; Inhoffenstr. 7B; D-38124 Braunschweig; Germany.

In the present application, ATCC means American Type Culture Collection. The address of ATCC is: American Type Culture Collection (ATCC); 10801 University Blvd.; Manassas, Va. 20110-2209; United States of America.

In the application, unless specified otherwise or unless a context dictates otherwise, all the terms have their ordinary meaning in the relevant field(s).

The term "comprising", which is synonymous with "including" or "containing", is open-ended, and does not exclude additional, unrecited element(s), ingredient(s) or method step(s), whereas the term "consisting of" is a closed term, which excludes any additional element, step, or ingredient which is not explicitly recited.

The term "essentially consisting of" is a partially open term, which does not exclude additional, unrecited element(s), step(s), or ingredient(s), as long as these additional element(s), step(s) or ingredient(s) do not materially affect the basic and novel properties of the invention.

The term "comprising" (or "comprise(s)") hence includes the term "consisting of" ("consist(s) of"), as well as the term "essentially consisting of" ("essentially consist(s) of"). Accordingly, the term "comprising" (or "comprise(s)") is, in the present application, meant as more particularly encompassing the term "consisting of" ("consist(s) of"), and the term "essentially consisting of" ("essentially consist(s) of").

In an attempt to help the reader of the present application, the description has been separated in various paragraphs or sections and/or in various embodiments. These separations should not be considered as disconnecting the substance of a paragraph or section and/or of an embodiment from the substance of another paragraph or section and/or of another embodiment. To the contrary, the present application encompasses all the combinations of the various sections, paragraphs and sentences that can be contemplated. The present application encompasses all the combinations of the various embodiments that are herein described.

Each of the relevant disclosures of all references cited herein is specifically incorporated by reference. The following examples are offered by way of illustration, and not by way of limitation.

EXAMPLES

Example 1

We produced a *Y. pseudotuberculosis* strain, which is both avirulent and genetically defined for use as vaccine against plague. To this end, we irreversibly attenuated the *Y. pseudotuberculosis* IP32953 strain by deletion of genes encoding three essential virulence factors (the High pathogenicity island, YopK and the pH6 Ag/PsaA).

We cloned the *Y. pestis* F1-encoding caf operon in a plasmid and introduced it into the attenuated *Y. pseudotuberculosis* strain, whereby generating an encapsulated derivative of attenuated *Y. pseudotuberculosis* strain. The resulting strain, named V674pF1 (1), produced the F1 capsule in vitro and in vivo. Oral inoculation of V674pF1 allowed the colonization of the gut without causing lesions in Peyer's patches and the spleen. Vaccination with V674pF1 induced both humoral and cellular components of immunity, at the systemic (IgG and Th1 cells) and the mucosal levels (IgA and Th17 cells). A single oral dose ($10^8$ CFU) protected 100% of animals against pneumonic plague (challenge dose $10^5$ CFU, i.e., 33×$LD_{50}$) and 94% with a higher dose ($10^3$ CFU, i.e., 3,300×$LD_{50}$) (1).

However, this vaccination protocol protected only 81% of the animals against bubonic plague with a low challenge dose ($10^3$ CFU, i.e., 100×$LD_{50}$) (cf. results below and FIG. 7A). In addition, we observed that production of the F1 capsule was unstable.

We generated another form of encapsulated derivative by inserting the *Y. pestis* caf operon encoding F1 into the chromosome of the attenuated *Y. pseudotuberculosis* strain, using a Tn7 mini-transposon. The resulting strain, named V674TnF1, was compared to strain V674pF1 for stability of F1 production, potential residual virulence of the strain and protective efficacy.

Ethics

Animals were housed in the Institut Pasteur animal facilities accredited by the French Ministry of Agriculture to perform experiments on live mice (accreditation B 75 15-01, issued on May 22, 2008), in appliance of the French and European regulations on care on protection of the Laboratory Animals (ED Directive 86/609, French Law 2001-486 issued on Jun. 6, 2001). Protocols were approved by the veterinary staff of the Institut Pasteur animal facility and were performed in compliance with the NIH Animal Welfare Insurance #A5476-01 issued on Feb. 7, 2007.

*Y. pestis* Strain

*Y. pestis* strain CO92 is a wild type strain of the Orientalis biotype (5).

The complete genome sequence of *Y. pestis* strain CO92 is available under accession number AL590842. In addition, *Y. pestis* strain CO92 contains three plasmids: pMT1 (also named pFra; accession number AL117211), pCD1 (also named pYV; accession number AL117189), and pPCP1 (also named pPLa; accession number AL109969). Plasmid pMT1 contains the caf operon and encodes the F1 capsule.

*Y. pseudotuberculosis* Strains

The *Y. pseudotuberculosis* IP32953 strain is a wild type serotype I strain (6). The complete genome sequence of *Y. pseudotuberculosis* IP32953 is available from NCBI under NC_006155 (SEQ ID NO: 19).

Strain IP32953p was produced by introduction of plasmid pKOBEG-sacB into strain IP32953 by electroporation (7). The vector pKOBEG-sacB (8) contains the Red operon expressed under the control of the arabinose inducible pBAD promoter and the sacB gene that is necessary to cure the plasmid (8, 9).

Strain V674 was produced from strain IP32953p by deletion of the HPI, yopK and psaA, as described in (1).

Construction of V674TnF1 and Verification of F1 Capsule Production

Cloning of the Caf Locus:

Cloning of the *Y. pestis* caf locus in the mini transposon Tn7 was performed as follows: The 5 kb caf locus that encodes the F1 capsule of *Y. pestis* was amplified by PCR with primers A (5'-ATAAGAATGAATTCGTGACTGAT-CAAATATGTTGG-3'; SEQ ID NO: 1) and B (5'-CGT-TAGGGCCCGTCAGTCTTGCTATCAATGC-3'; SEQ ID NO: 2), which add an ApaI and EcoRI site at the extremities of the locus. The PCR product was ligated to the corresponding sites in the mini transposon Tn7 carried by the pUC18R6KTn7-$Cm^R$ plasmid (FIG. 1), generating plasmid pUC18R6KTn7-Cm$^R$-caf. The presence of the caf locus was verified by PCR using primers 157A (5'-CAGGAAC-CACTAGCACATC-3'; SEQ ID NO: 3) and 157B (5'-CCCCCACAAGGTTCTCAC-3'; SEQ ID NO: 4) internal to the caf1 gene.

Insertion of the Caf Locus into the *Y. pseudotuberculosis* Chromosome

To insert the caf locus into the *Y. pseudotuberculosis* V674 chromosome we used the mini Tn7 tool (2). Plasmids pUC18R6KTn7-Cm$^R$-caf and pTNS2 (transposase provider) were used together to electroporate the *Y. pseudotuberculosis* vaccine strain V674 (1), and the transposants were selected on LB agar plates containing Chloramphenicol.

The presence of the transposon that contains the caf locus (named "Mini Tn7-caf-Cm$^R$ transposon", FIG. 2) was verified by PCR, using two pairs of primers: 744 (5'-CACAG-CATAACTGGACTGATTTC-3'; SEQ ID NO: 5) and 747 (5'-GCTATACGTGTTTGCTGATCAAGATG-3'; SEQ ID NO: 6) for the left junction, and 745 (5'-ATTAGCTTAC-GACGCTACACCC-3'; SEQ ID NO: 7) and 746 (5'-ACGC-CACCGGAAGAACCGATACCT-3'; SEQ ID NO: 8) for the right junction. The recombinant *Y. pseudotuberculosis* strain that contains the Tn7-caf-Cm$^R$ region in its chromosome was named V674TnF1.

Since the transposase-encoding plasmid is not harbored by the recombinant V674TnF1, excision of the Tn7-caf-Cm$^R$ region by transposition does not occur.

Verification of F1 Capsule Production

Figure 3:
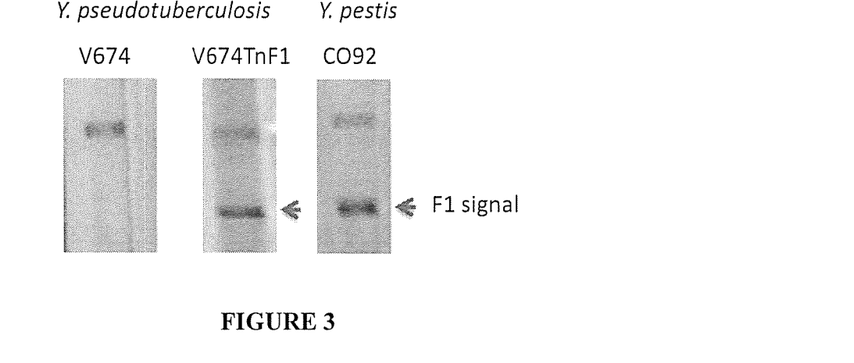
FIG. 3: Detection of the production of *Y. pestis* F1 by an attenuated *Y. pseudotuberculosis* strain, in which the caf operon has been inserted into the genome (strain V674TnF1). V674 is the parental strain that does not possess a caf operon. CO92 is the *Y. pestis* strain used for the cloning of the caf operon.

To estimate the F1 capsule production by the recombinant V674TnF1 vaccine, the strain was grown at 37° C. in LB broth, and a F1 dipstick test (3) was performed on cell suspensions. As shown on FIG. 3, a band at the same position as the positive *Y. pestis* control was observed with CO92 (positive control) whereas no signal was detected with the V674 parental strain (negative control), thus indicating that V674TnF1 synthesizes the F1 capsule.

Figure 4:
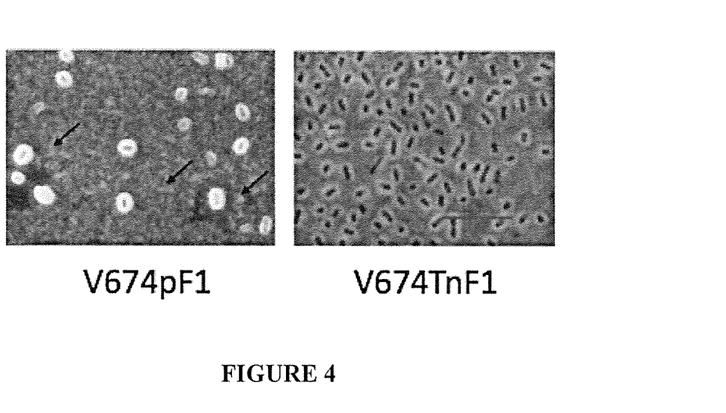
FIG. 4: Detection of F1 capsules around attenuated *Y. pseudotuberculosis* cells, which comprise the *Y. pestis* caf operon either on a plasmid (*Y. pseudotuberculosis* strain V674pF1; left-hand panel) or inserted into the chromosome (*Y. pseudotuberculosis* V674TnF1; right-hand panel). In V674pF1, numerous bacteria are not surrounded by a capsule (some examples are shown with an arrow), while all V674TnF1 cells are encapsulated.

To further visualize the F1 capsule, we examined microscopically the V674TnF1 strain grown at 37° C. Exclusion of India ink around V674TnF1 bacterial cells confirmed the presence of the capsule (FIG. 4).

Furthermore, all bacterial cells were surrounded by a halo, indicating that, in contrast to V674 pF1, all bacteria produced the F1 capsule. After two subcultures in LB, all bacterial cells continued to produce F1. Therefore, the synthesis of F1 is much more stable in V674TnF1 than in V674pF1.

Attenuation of Virulence

The V674 strain used to construct V674pF1 and V674TnF1 had been modified to attenuate its virulence by deletion of 3 virulence factors (the High Pathogenicity Island, the pH6 Ag/PsaA pilus, and the YopK factor) by genetic engineering (1).

The virulence of the V674pF1 and V674TnF1 strains was tested after intragastric administration. In both cases, the $LD_{50}$ was $>10^{10}$ CFU, demonstrating a very strong attenuation of virulence. However, we noticed occasional mouse deaths after intragastric vaccination, which were not related to the vaccine dose used (see Table 1 below), and which most likely resulted from accidental lesions caused by the intragastric canulla used to administrate the vaccine.

The virulence of the V674TnF1 strain was also tested after subcutaneous (SC) administration. After subcutaneous injection of doses of the V674TnF1 strain up to $10^9$ CFU, no deaths were observed Skin papules were observed in all mice vaccinated with $10^9$ CFU of V674TnF1, in about 50% at $10^8$ CFU and <10% at $10^7$ CFU.

TABLE 1

| Inoculation doses (CFU) | % mortality (number of deaths/total inoculated mice) | | |
|---|---|---|---|
| | V674pF1 Intragastric | V674TnF1 Intragastric | V674TnF1 Subcutaneous |
| $10^7$ | 0% (0/16) | 4.1% (1/24) | 0% (0/16) |
| $10^8$ | 2% (1/48) | 3.6% (2/55) | 0% (0/13) |
| $10^9$ | 0% (0/56) | 2.5% (1/40) | 0% (0/8) |
| $10^{10}$ | 0% (0/8) | 0% (0/8) | Not done |

Persistence of V674TnF1 in Mice Upon Oral Inoculation

Figure 5A:
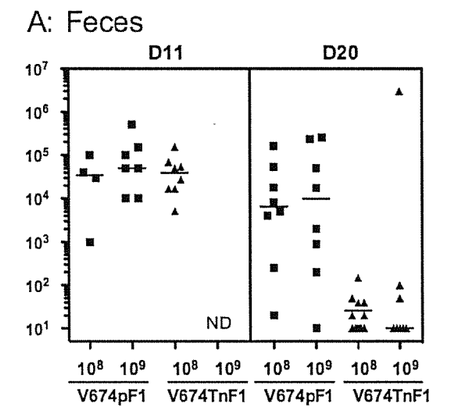
FIGS. 5A, 5B and 5C: Attenuated *Y. pseudotuberculosis* cells, which carry the *Y. pestis* caf operon, persist in the intestinal flora (FIG. 5A), the Peyer's patches (FIG. 5B), and the spleen (FIG. 5C) of mice vaccinated orally with $10^8$ or $10^9$ CFU.

After oral inoculation of either $10^8$ or $10^9$ CFU, V674TnF1 bacterial cells were detected in the feces of only 3 out of 8 mice on D20, and only with the $10^9$ CFU vaccine dose (FIG. 5A), indicating a relatively rapid clearance of the vaccine from the gut lumen.

Figure 5B:
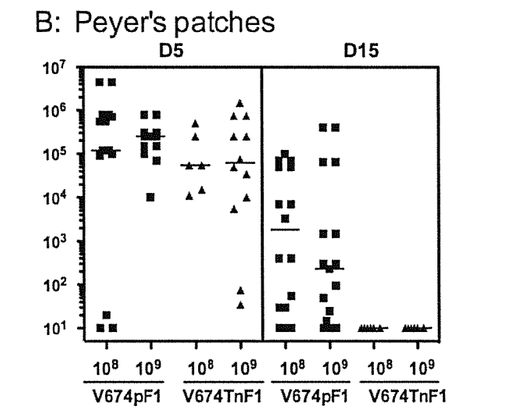
Figure 5C:
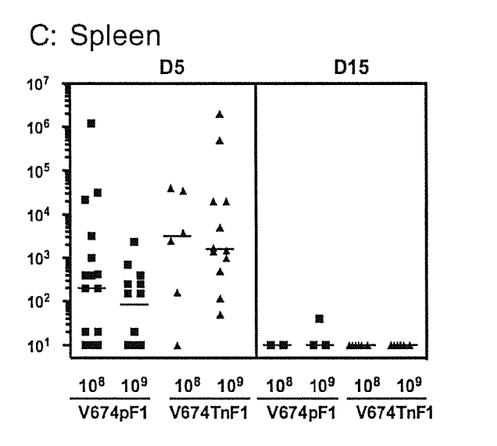

In Peyer's patches and the spleen, V674TnF1 was detected after 5 days, but was cleared after 15 days (FIGS. 5B and 5C), regardless of the dose administered.

In contrast, V674pF1 bacterial cells were still detectable in Peyer's patches and in the spleen of 1/5 mouse on D15, indicating that V674TnF1 is more rapidly cleared from the vaccinated animals than the V674pF1 strain.

Altogether, our observations demonstrate that V674TnF1 administered orally is able to colonize the gut, Peyer's patches and spleen, but this colonization is only transient, and bacteria are cleared from deep organs before D15.

Protection Conferred Against Bubonic and Pneumonic Forms of Plague

To evaluate and compare the protective efficacy of V674pF1 and V674TnF1, mice were vaccinated and were infected one month later either intranasally (IN, pneumonic plague) or subcutaneously (SC, bubonic plague) with the fully virulent *Y. pestis* strain CO92 (4). For each infection route, two lethal challenges of CO92 were tested, with a moderate and a high dose of the fully virulent *Y. pestis* strain CO92.

TABLE 2

| | Moderate challenge | | Severe challenge | |
|---|---|---|---|---|
| | CFU | x $LD_{50}$ | CFU | x $LD_{50}$ |
| IN | $10^5$ | 33 | $10^7$ | 3,300 |
| SC | $10^3$ | 100 | $10^5$ | 10,000 |

Oral Vaccination

Figure 6A:
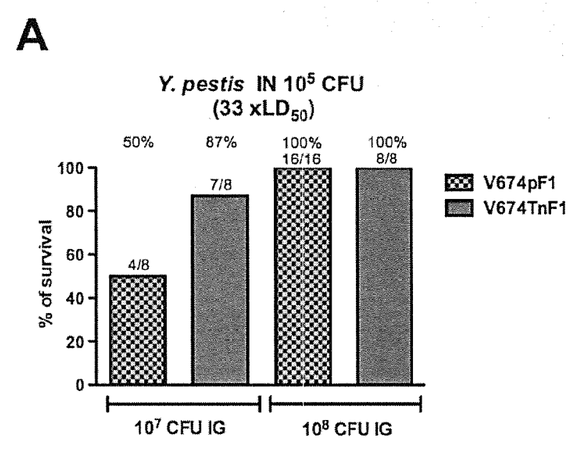
FIGS. 6A and 6B: Protection conferred by a single oral vaccination with attenuated *Y. pseudotuberculosis* cells, which carry the *Y. pestis* caf operon either on a plasmid (strain V674pF1) or inserted into the chromosome (strain V674TnF1), against pneumonic plague following a moderate (FIG. 6A) or a severe (FIG. 6B) intranasal challenge with *Y. pestis* (pneumonic plague).

—Protection Against Pneumonic Plague:

A dose of $10^7$ CFU of either V674pF1 or V674TnF1 strain did not confer full protection against a moderate IN challenge with *Y. pestis* (FIG. 6A).

In contrast, a dose of $10^8$ CFU of either strain protected 100% of the animals against a similar challenge (FIG. 6A).

Figure 6B:
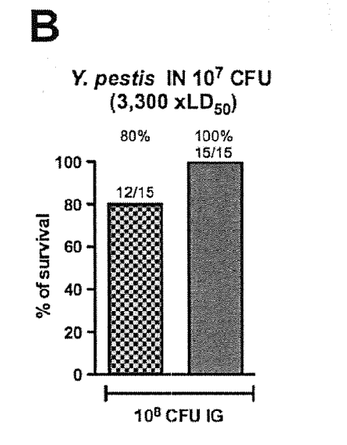

Since the $10^8$ CFU dose was effective, a severe bacterial challenge was tested (FIG. 6B). Following this high challenge, only 80% of the mice vaccinated with V674pF1 survived, while all animals vaccinated with V674TnF1 survived.

Our results thus show the higher protective effect of V674TnF1 over V674pF1 and indicate that a single oral dose of V674TnF1 is sufficient to fully protect against pneumonic plague, even after exposure to high *Y. pestis* loads.

Figure 7A:
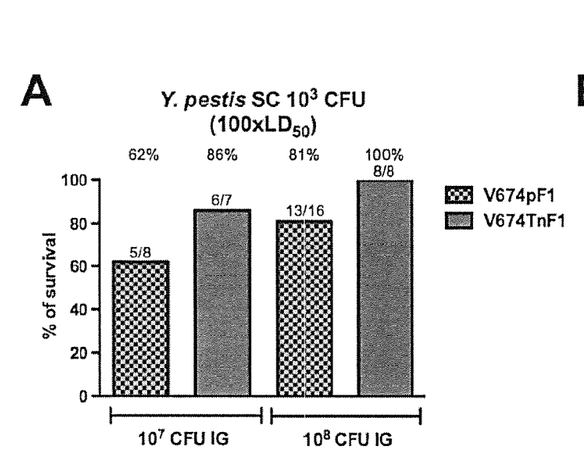
FIGS. 7A and 7B: Protection conferred by a single oral vaccination with attenuated *Y. pseudotuberculosis* cells, which carry the *Y. pestis* caf operon either on a plasmid (strain V674pF1) or inserted into the chromosome (strain V674TnF1), against bubonic plague following a moderate (A) or a severe (B) subcutaneous challenge with *Y. pestis* (bubonic plague).

—Protection Against Bubonic Plague:

A single oral administration of $10^7$ CFU of V674pF1 or V674TnF1 was not sufficient to obtain 100% protection against a moderate SC challenge with *Y. pestis* (FIG. 7A).

At a dose of $10^8$ CFU, V674pF1 conferred 86% protection, while V674TnF1 protected 100% of the vaccinated mice (FIG. 7A).

Figure 7B:
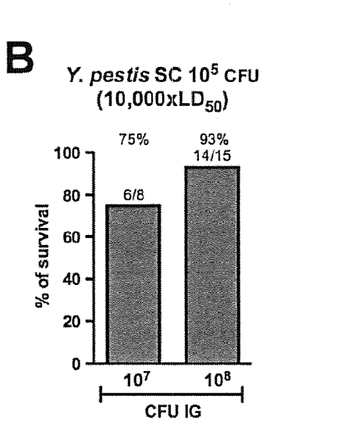

When the challenge dose was increased to $10,000 \times LD_{50}$, a single oral administration of $10^8$ CFU of V674TnF1 still protected 93% of the animals (FIG. 7B).

V674TnF1 is thus more effective than V674pF1 at protecting against bubonic plague.

Altogether, our results demonstrate that a single oral inoculation of $10^8$ CFU of V674TnF1 is very efficient at vaccinating mice against both pneumonic and bubonic plague, even when the animals are challenged with very high doses of the fully virulent *Y. pestis* strain CO92.

Subcutaneous Vaccination

Since one of the 15 mice vaccinated with V674TnF1 did not survive after a severe SC challenge, we wondered whether it would be possible to increase even further the protection by using another route of vaccination.

—Protection Against Pneumonic Plague after SC Vaccination

Figure 8:
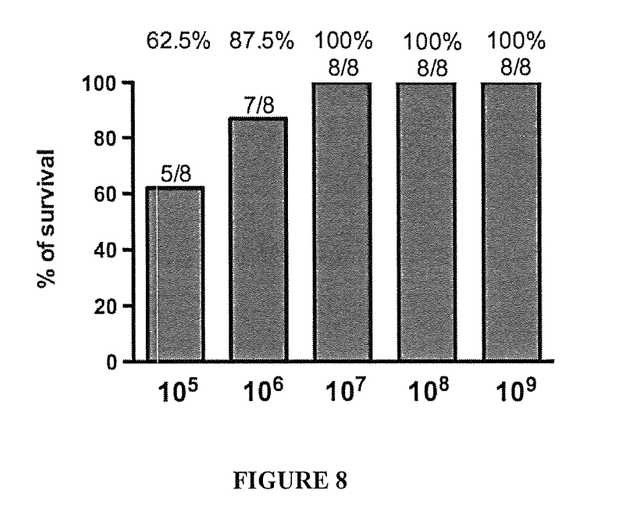
FIG. 8: Protection conferred by a single subcutaneous inoculation of $10^7$ or $10^8$ CFU of attenuated *Y. pseudotuberculosis* cells, wherein the *Y. pestis* caf operon has been inserted into the chromosome (strain V674TnF1), against bubonic plague (subcutaneous infection) with a severe challenge of *Y. pestis* (strain CO92).

To test the protective efficacy of an SC inoculation of V674TnF1, a single vaccine dose of $10^5$ to $10^9$ CFU was injected and the animals were challenged with a high IN inoculum ($10^7$ CFU=$3,300 \times LD_{50}$) of *Y. pestis* CO92. Full protection was obtained with vaccine doses of $10^7$ CFU and higher (FIG. 8).

—Protection Against Bubonic Plague after SC Vaccination

The protection conferred by a single SC injection of V674TnF1 ($10^7$ or $10^8$ CFU) against bubonic plague (severe challenge: $10,000 \times LD_{50}$) was then evaluated.

Figure 9:
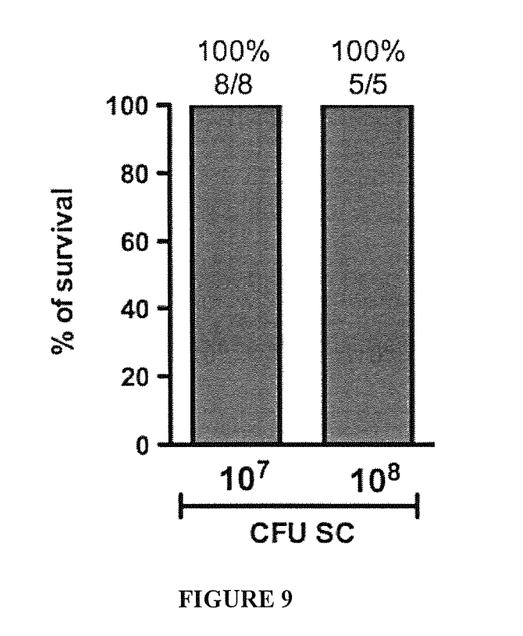
FIG. 9: Protection conferred by a single subcutaneous inoculation of various doses of attenuated *Y. pseudotuberculosis* cells, wherein the *Y. pestis* caf operon has been inserted into the chromosome (strain V674TnF1), against pneumonic plague (intranasal infection) with a severe challenge of *Y. pestis* (strain CO92).

A single vaccination with either dose protected 100% of the animals against a severe challenge dose ($10,000 \times LD_{50}$) of *Y. pestis* CO92 administered SC (FIG. 9), indicating an efficiency even higher than that of the oral vaccination against bubonic plague.

CONCLUSIONS

The V674TnF1 *Y. pseudotuberculosis* strain, in which the operon encoding the *Y. pestis* capsular antigen F1 has been inserted into the chromosome, is an efficient vaccine against both bubonic plague and pneumonic plague.

The V674TnF1 *Y. pseudotuberculosis* strain notably has the following advantages:

genetic stability: V674TnF1 is a *Y. pseudotuberculosis* strain, whose genome is much more stable than that of *Y. pestis*;

innocuity: V674TnF1 is highly attenuated, due to the irreversible deletion of three genes essential to distinct virulence mechanisms: adhesion (pH6 Ag/PsaA), iron capture (HPI), secretion of Yop toxins (YopK);

molecular diversity: as a live whole cell vaccine, it offers a high antigenic complexity, which guarantees a response against a broad range of antigenic targets; antigens are in their native form, adequately processed, and produced de novo as long as the bacteria persist;

easy manufacturing: once developed and validated, live vaccines do not require sophisticated equipments and techniques to be produced;

immunogenicity: adjuvant is not required, since bacterial antigens (LPS and other pathogen associated signatures) trigger the innate immune system; in addition to antigens common to *Y. pestis* and *Y. pseudotuberculosis*, V674TnF1 stably produces the F1 capsule, which is a major vaccine target against *Y. pestis*;

single dose administration: this is a major advantage as it greatly facilitates vaccination campaigns and allows a rapid protection;

vaccination possible by two routes: depending on the context, an SC or oral route of vaccination may be preferred.

Furthermore, V674TnF1 has very high vaccine efficacy. Animals vaccinated with V674TnF1 are fully protected against both bubonic and pneumonic plague, even when exposed to very high doses of the plague *bacillus*.

In contrast, V674pF1 achieves a lower vaccine efficacy, more particularly with respect to bubonic plague.

To our knowledge, the level of protection against bubonic and pneumonic plague conferred by a single dose of the V674TnF1 vaccine is one of the most, and probably the most efficient ever reported.

We further observed that V674TnF1 surprisingly is more rapidly cleared from the gut of the vaccinated animals than V674pF1, and that subcutaneous or oral administration of V674TnF1 are efficient route of administration depending on the intended use in prevention or urgent treatment.

BIBLIOGRAPHIC REFERENCES

1. Derbise, A., Cerda Marin, A., Ave, P., Blisnick, T., Huerre, M., Carniel, E., and Demeure, C. E. (2012) An encapsulated *Yersinia pseudotuberculosis* is a highly efficient vaccine against pneumonic plague. *PLoS Negl Trop Dis* 6, e1528
2. Choi, K. H., Gaynor, J. B., White, K. G., Lopez, C., Bosio, C. M., Karkhoff-Schweizer, R. R., and Schweizer, H. P. (2005) A Tn7-based broad-range bacterial cloning and expression system. *Nat Methods* 2, 443-448
3. Chanteau, S., Rahalison, L., Ralafiarisoa, L., Foulon, J., Ratsitorahina, M., Ratsifasoamanana, L., Carniel, E., and Nato, A. (2003) Development and testing of a rapid diagnostic test for bubonic and pneumonic plague. *Lancet* 361, 211-216
4. Chain, P. S., Cannel, E., Larimer, F. W., Lamerdin, J., Stoutland, P. O., Regala, W. M., Georgescu, A. M., Vergez, L. M., Land, M. L., Motin, V. L., Brubaker, R. R., Fowler, J., Hinnebusch, J., Marceau, M., Medigue, C., Simonet, M., Chenal-Francisque, V., Souza, B., Dacheux, D., Elliott, J. M., Derbise, A., Hauser, L. J., and Garcia, E. (2004) Insights into the evolution of *Yersinia pestis* through whole-genome comparison with *Yersinia pseudotuberculosis*. *Procedings of the National Academy of Sciences of the United States of America* 101, 13826-13831
5. Parkhill, J., Wren, B. W., Thomson, N. R., Holden, M. T. G., et al. (2001) Genome sequence of *Yersinia pestis*, the causative agent of plague. Nature 413: 523-527
6. Chain, P., Regala, W., Mariero, L., Souza, B., Elliott, J., et al. (2002) Whole genome sequencing of *Yersinia pseudotuberculosis*: Examining pathogen evolution among the recently emerged *Yersinia*. Abstracts of the General Meeting of the American Society for Microbiology 102
7. Pouillot, F., Derbise, A., Kukkonen, M., Foulon, J., Korhonen, T. K., et al. (2005) Evaluation of O-antigen inactivation on Pla activity and virulence of *Yersinia pseudotuberculosis* harbouring the pPla plasmid. Microbiology 151: 3759-3768

8. Derbise, A., Lesic, B., Dacheux, D., Ghigo, J. M., Carniel, E. (2003) A rapid and simple method for inactivating chromosomal genes in *Yersinia*. FEMS Immunol Med Microbiol 38(2):113-116.
9. Datsenko, K., A., Wanner, B. L. (2000) One-step inactivation of chromosomal genes in *Escherichia coli* K-12 using PCR products. Proc. Natl. Acad. Sci. U.S.A. 97(12): 6640-6645.
10. Grinter, N. J. (1983). A broad-host-range cloning vector transposable to various replicons. Gene 21: 133-143.
11. Barry, G. F. (1986). Permanent insertion of foreign genes into the chromosome of soil bacteria. Bio/Technology 4: 446-449.
12. Bao, Y., D. P. Lies, H. FU, and G. P. Roberts (1991). An improved Tn7-based system for the single-copy insertion of cloned genes into chromosomes of Gram-negative bacteria. Gene 109: 167-168.
13. Højberg, O., U. Schnider, H. V. Winteler, J. Sørensen, and D. Haas (1999). Oxygen-sensing reporter strain of *Pseudomonas fluorescens* for monitoring the distribution of low-oxygen habitats in soil. Appl. Environ. Microbiol. 65: 4085-4093.
14. Koch, B., L. E. Jensen, and O. Nybroe (2001). A panel of Tn7-based vectors for insertion of the gfp marker gene or for delivery of cloned DNA into Gram-negative bacteria at a neutral chromosomal site. J. Microbiol. Meth. 45: 187-195.

SEQUENCE LISTING (19 sequences)

SEQ ID NO: 1 - DNA, 34 bp, Yersinia pestis
ataagaatgaattcgtgactgatcaatatgttgg

SEQ ID NO: 2 - DNA, 31 bp, Yersinia pestis
cgttagggcccgtcagtcttgctatcaatgc

SEQ ID NO: 3 - DNA, 19 bp, Yersinia pestis
caggaaccactagcacatc

SEQ ID NO: 4 - DNA, 18 bp, Yersinia pestis
cccccacaaggttctcac

SEQ ID NO: 5 - DNA, 23 bp, Yersinia pestis
cacagcataactggactgatttc

SEQ ID NO: 6 - DNA, 26 bp, Yersinia pestis
gctatacgtgtttgctgatcaagatg

SEQ ID NO: 7 - DNA, 22 bp, Yersinia pestis
attagcttacgacgctacaccc

SEQ ID NO: 8 - DNA, 24 bp, Yersinia pestis
acgccaccggaagaaccgatacct

SEQ ID NO: 9 - DNA, 513 bp, Yersinia pestis
atgaaaaaaatcagttccgttatcgccattgcattatttggaactattgcaactgctaatgcggcagatttaactgcaagcaccactgcaacggcaactcttgttgaaccagcccgcatcactcttacatataaggaaggcgctccaattacaattatggacaatggaaacatcgatacagaattacttgttggtacgcttactcttggcggctataaaacaggaaccactagcacatctgttaactttacagatgccgcgggtgatcccatgtacttaacatttacttctcaggatggaaataaccaccaattcactacaaaagtgattggcaaggattctagagattttgatatctctcctaaggtaaacggtgagaaccttgtgggggatgacgtcgtcttggctacgggcagccaggatttctttgttcgctcaattggttccaaaggcggtaaacttgcagcaggtaaatacactgatgctgtaaccgtaaccgtatctaaccaataa

SEQ ID NO: 10 - protein, 170 aa, Yersinia pestis
MKKISSVIAIALFGTIATANAADLTASTTATATLVEPARITLTYKEGAPITIMDNGNIDTELLVGTLTLGGYKTGTTSTSVNFTDAAGDPMYLTFTSQDGNNHQFTTKVIGKDSRDFDISPKVNGENLVGDDVVLATGSQDFFVRSIGSKGGKLAAGKYTDAVTVTVSNQ

SEQ ID NO: 11 - DNA, 450 bp, Yersinia pestis
gcagatttaactgcaagcaccactgcaacggcaactcttgttgaaccagcccgcatcactcttacatataaggaaggcgctccaattacaattatggacaatggaaacatcgatacagaattacttgttggtacgcttactcttggcggctataaaacaggaaccactagcacatctgttaactttacagatgccgcgggtgatcccatgtacttaacatttacttctcaggatggaaataaccaccaattcactacaaaagtgattggcaaggattctagagattttgatatctctcctaaggtaaacggtgagaaccttgtgggggatgacgtcgtcttggctacgggcagccaggatttctttgttcgctcaattggttccaaaggcggtaaacttgcagcaggtaaatacactgatgctgtaaccgtaaccgtatctaaccaataa

SEQ ID NO: 12 - protein, 149 aa, Yersinia pestis
ADLTASTTATATLVEPARITLTYKEGAPITIMDNGNIDTELLVGTLTLGGYKTGTTSTSVNFTDAAGDPMYLTFTSQDGNNHQFTTKVIGKDSRDFDISPKVNGENLVGDDVVLATGSQDFFVRSIGSKGGKLAAGKYTDAVTVTVSNQ

SEQ ID NO: 13 - DNA, 777 bp, Yersinia pestis
atgattttaaatagattaagtacgttaggaattattactttcggcatgcttagttttgctgcgaactctgctcaaccagatatcaaattcgcaagcaaagagtatggcgtgactataggtgagagtaggatcatatacccgttagatgctgctggcgttatggtctcggtgaaaaacacccaagattatccggttctcattcagtctaggatctacgacgagaataaagaaaaagaatcagaggatcctttcgtggtcactccgccattgtttcgattggatgctaagcaacaaaattctttgcgtatagctcaggctggaggtgttttcccgcgagataaagagagcctaaagtggttatgcgtaaaagggattccaccaaaggatgaagatatatgggttgatgatgcgacaaataagcaaaaattcaatccagacaaagatgtgggagtgttcgtgcaattcgcaattaataattgcattaagcttttggttcgaccgaatgaattaaaaggaacccctatacagtttgctgaaaacttaagctggaaagttgatggggggaagctaattgctgaaaacccctcacctttctacatgaacataggtgaattaacatttggagggaaaagtattccttctcactatattccacctaaatcgacgtgggcttttgatttgccaaaaggactagcgggagcacgtaatgtttcgtggagaataattaatgatcagggagggttggatcgtttgtattccaaaaatgtgactttatga

SEQ ID NO: 14 - protein, 258 aa, Yersinia pestis
MILNRLSTLGIITFGMLSFAANSAQPDIKFASKEYGVTIGESRIIYPLDAAGVMVSVKNTQDYPVLIQSRIYDENKEKESEDPFVVTPPLFRLDAKQQNSLRIAQAGGVFPRDKESLKWLCVKGIPPKDEDIWVDDATNKQKFNPDKDVGVFVQFAINNCIKLLVRPNELKGTPIQFAEKLSWKVDGGKLIAENPSPFYMNIGELTFGGKSIPSHYIPPKSTWAFDLPKGLAGARNVSWRIINDQGGLDRLYSKNVTL

SEQ ID NO: 15 - DNA, 2502 bp, Yersinia pestis
atgaggtattcaaagctgttcctgtgtgcagggttaactttggcaacattgccttgttggggacgcgcatatacttttgactctactatgcttgatacgaatagtggagagagtatagatgtatctctttttaatcaaggacttcaacttccaggtaattattttgttaatgtttttgtaaatggtcgaaaggtagactctggaaatatcgacttccgtctagaaaaacataatggaaaagaacttctttggccatgcctatcatccttacaattgacaaagtatggcattgatatagataaatatcctgatttaataaaatctggtacagagcaatgtgttgatttattagcaataccacattcagatgtgcagttttattttaatcagcagaaattatcgttaattgtgccaccacaggcacttttacctagatttgatggcattatgccaatgcaattgtgggatgacggcattcctgctctgttcatgaattataatacgaacatgcagacaagaaaattcagagaaggaggcaagtctctggactcttattatgctcagttgcaaccgggattaaacataggggcttggcgctttcgtagttcaacctcatggtggaaacaacaaggatggcagcgttcgtatatttatgccgagcgaggattgaatacaattaagagccgtttgacattgggggaaacctattctgatagcagtatctttgacagtatcccgattaaggggataaaaattgcttcagatgaatcgatggttccttattaccaatggaattttgctccagttgttcgcggtatcgcacgtacacaagccagggtagaggttttaagagatggctacactgtaagtaatgagttggtgccctcgggaccatttgagttagcaaatcttcctctgggtggggggagtggtgagctgaaagtcatcattcatgaaagtgatggaacaaagcaagtttttacagttccatatgacacaccagcagtggcattacggaagggctatttcgaatattcaatgatggggggagaatatcgtccagctaatgatcttacacaaacatcgtatgttggcgctcttgggatgaaatatggtttgccaaggaatcttacgttatatggtggactacaagggtcccaaaattatcatgccgcagctctgggtatcggtgctatgttgggtgattttggtgccatatctacagatgttactcaagcagacagccagaaaaataaacaaaaaaaagaaagcggccaacgttggcgcgttcgatataataagtacttgcagagtggaacatcgttaaacattgctagcgaggaatacgccacagaaggatttaacaaactcgctgacacgttaaatacttattgtaaacctaatactagaaacgattgccgttttgattatgctaaacccaaaaacaaagtgcaattcaatttaagtcaaagcatacctggttcggggacgcttaatttcagtggctacagaaaaaactattggcgtgacagtaggagcacaacttctttttctgtaggctataaccatttttttaggaatggtatgtcattgactttaaatttatcgaagacacagaatatcaataagtatggagaaaaaactagtgagctattatctaatatctggttgagttttcctctcagtcgctggctaggtaataactcaataaattcaaattaccaaatgacatcagattctcatggtaacactacccatgaggtaggtgtgtacggtgaagcctttgatcgccaattatactgggacgttcgcgaacgttttaatgaaaagggcagaaaatatacctccaatgcactgaatttgaattatcgaggaacttatggggagatcagtggtaactacagctacgatcaaacccaaagccaacttggtataggtgtaaatggcaatatggtaataactcagtacggtataacggctggccaaaaaactggagatactattgcattagtacaagcccctgatataagcggtgcttcagtgggatactggccaggcatgaaaacagactttagggggtacaccaattatggttacttaaccccttacagagagaataaggtagaaattaacccagttactttacccaatgatgcagagataacaaataatattgttagcgtgatcccgacaaagggagctgtagtattagcaaaatttaacgcaaggattggtggacgattgtttttacatttaaaacgctctgacaataaacctgttccatttggttctatagttaccattgaagggcaatcatccagctctggcattgtcggagataatagcggtgtctatttgactggactacctaaaaaatcaaaaatacttgttaagtgggggagagataaaaatcaatcatgttcatctaatgtagttctaccagaaaaaacggatatttctggtgcttataggttatccacaacctgcatcttaaataactga

SEQ ID NO: 16 - protein, 833 aa, Yersinia pestis
MRYSKLFLCAGLTLATLPCWGRAYTFDSTMLDTNSGESIDVSLFNQGLQLPGNYFVNVFVNGRKVDSGNIDFRLEKHNGKELLWPCLSSLQLTKYGIDIDKYPDLIKSGTEQCVDLLAIPHSDVQFYFNQQKLSLIVPPQALLPRFDGIMPMQLWDDGIPALFMNYNTNMQTRKFREGGKSLDSYYAQLQPGLNIGAWRFRSSTSWWKQQGWQRSYIYAERGLNTIKSRLTLGETYSDSSIFDSIPIKGIKIASDESMVPYYQWNFAPVVRGIARTQARVEVLRDGYTVSNELVPSGPFELANLPLGGGSGELKVIIHESDGTKQVFTVPYDTPAVALRKGYFEYSMMGGEYRPANDLTQTSYVGVFGMKYGLPRNFTLYGGLQGSQNYHAEALGIGAMLGDFGAISTDVTQADSQKNKQKKESGQRWRVRYNKYLQSGTSLNIASEEYATEGFNKLADTLNTYCKPNTRNDCRFDYAKPKNKVQFNLSQSIPGSGTLNFSGYRKNYWRDSRSTTSFSVGYNHFFRNGMSLTLNLSKTQNINKYGEKTSELLSNIWLSFPLSRWLGNNSINSNYQMTSDSHGNTTHEVGVYGEAFDRQLYWDVRERFNEKGRKYTSNALNLNYRGTYGEISGNYSYDQTQSQLGIGVNGNMVITQYGITAGQKTGDTIALVQAPDISGASVGYWPGMKTDFRGYTNYGYLTPYREYKVEINPVTLPNDAEITNNIVSVIPTKGAVVLAKFNARIGGRLFLHLKRSDNKPVPFGSIVTIEGQSSSSGIVGDNSGVYLTGLPKKSKILVKWGRDKNQSCSSNVVLPEKTDISGAYRLSTTCILNN

SEQ ID NO: 17 - DNA, 906 bp, Yersinia pestis
atgctaaaacagatgactgtaaattcaattattcaatatatagaagagaatctcgagtcgaaattcattaacattgactgtttggttttgtattcaggattcagcagaaggtatttgcaaatttcctttaaggaatatgtcggaatgcctattggaacatatattagagttagaagggctagtagagctgctgcactattacggcttaccaggctgacaataatagagatatcagcaaagcttttttatgattcgcaacagacattcaccagagaatttaagaaaatatttggttataccccacggcagtataggatgatccctttttggtcctttaaaggtttgttgggtagaagggaaattaactgtgaataccttcaaccacgaatctgttaccttaaagagagaaatataattggtcaatgctttaattttagggatttagtgttctactctgggatagattcaaaatgtagattgggtaagttatatgattcgttgaagaaaaatacagctataacagtatcaaacagaatcccctttcatgataaaacgaatgacattattgcaagaacggttgtttgggataggaataagcatttcagcgatagtgaaataaaggtagataaaggcctgtatgcttattttttcttcaatgatacatatgatcagtatgttcatcacatgtacaacatatattataactctttgcctatttataatttaaataagcgggatggttacgatgtggaggtcataaaaagacgaaatgacaatactattgattgtcattattttctcccgatttattgtgatgacatggagttttacaatgaaatgcaggtatatcacaataatattgtgaagccggaaatgtcagtaacattaggattaccaaagagttaa

SEQ ID NO: 18 - protein, 301 aa, Yersinia pestis
MLKQMTVNSIIQYIEENLESKFINIDCLVLYSGFSRRYLQISFKEYVGMPIGTYIRVRRASRAAALLRLTRLTIIEISAKLFYDSQQTFTREFKKIFGYTPRQYRMIPFWSFKGLLGRREINCEYLQPRICYLKERNIIGQCFNFRDLVFYSGIDSKCRLGKLYDSLKKNTAITVSNRIPFHDKTNDIIARTVVWDRNKHFSDSEIKVDKGLYAYFFFNDTYDQYVHHMYNIYYNSLPIYNLNKRDGYDVEVIKRRNDNTIDCHYFLPIYCDDMEFYNEMQVYHNNIVKPEMSVTLGLPKS

SEQ ID NO: 19 - DNA, 4744671 bp, Yersinia pseudotuberculosis (residues 1-1,581,557 of 4,744,671)
gatctttttatttaaagatctctttattagatctcttattaggatcatgatcctctgtggataagtgattattcacatggaagatcatataattaaggaggatcgtttgttgtgagtgaccggtgatcctattgcgtataagctgggatctaaatggcatgttatgcacaggcactcggcagaatcaaggttgttatgtggatatctactggttttaccctgcttttaagcatagttatacacattcgttcgcgcgatctttgagctaattagagtaaattaatccaatctttgacccaaatctctgctggatcctctggtatttcatgttggatgacgtcaatttctaatatttcacccaaccgttgagcaccttgtgcgatcaattgttgatccagttttatgattgcaccgcagaaagtgtcatattctgagctgcctaaaccaaccgccccaaagcgtacttgggataaatcaggcttttgttgttcgatctgttctaataatggctgcaagttatcaggtagatccccggcaccatgagtggatgtcacgattaaccacaggccattcagcgtaagttcgtccaactctgggccatgaagtatttctgtagaaaacccagcttcttctaatttatccgctaaatgttcagcaacatattcagcactaccaagcgtactgccacttatcaacgttatgtcagccattcaagaacccaactgaagtaaagagctggcattgtactctgtgaatcagctgggatctagctgtggataatgtgggtatagttattttagggttaaggaacgatcgtacgcatgatagggttttgcagtgatattagtgtctcggttgactggatctcatcaatagtctggattttgttgataagtacctgctgcaatgcatcaatggatttacacatcactttaataaatatgctgtagtggccagtggtgtaataggcctcaaccacttcttctaagctttccaattttttcaaggcggaagggtaatctttggcacttttcaagattatgccaataaagcagcaaacgtcgtaacccagttgttttgggttaacgtgtacacaagctgcggtaatgatccctgcttgccgcatcttttctactcttacatgaatagttccggggctaacagcgaggtttttggctaattcagcatagggtgtgcgtgcattttccattaatgctttcaggatgctgcgatcgagattatcgatctgataaatttcactcatatttcccccgtttttttatcgatatctcaattatagtgccatataaattcattattaaaaccataatggctatatttgttattggatattgaatttaaccctcattctgttgcttaatcgatgacaagccagtaggcataactaaacataacgaattgagaaaacagcaatgaaaaaacaatttatccaaaaacaacaacaaatcagcttcgtaaaatcattcttttcccgccaattagagcaacaacttggcttgatcgaagtccaggctcctattttgagccgtgtgggtgatggaacccaagataacctttctggttctgagaaagcggtacaggtaaaagttaagtcattgccggattcaacttttgaagttgtacattcattagcgaagtggaaacgtaaaaccttagggcgttttgattttggtgctgaccaaggggtgtatacccatatgaaagcattgcgcccagatgaagatcgcctgagtgctattcattctgtatatgtagatcagtgggattgggaacgggttatgggggacggtgaacgtaacctggcttacctgaaatcgactgttaacaagatttatgcagcgattaaagaaactgaagcggcgatcagtgctgagtttggtgtgaagcctttcctgccggatcatattcagtttatccacagtgaaagcctgcgggccagattccctgatttagatgctaaaggccgtgaacgtgcaattgccaaagagttaggtgctgtcttccttatagggattggtggcaaattggcagatggtcaatcccatgatgttcgtgcgccagattatgatgattggacctctccgagtgcggaaggtttctctggattaaacggcgacattattgtctggaacccaatattggaagatgcctttgagatatcttctatgggaattcgtgttgatgccgaagctcttaagcgtcagttagccctgactggcgatgaagaccgcttggaactggaatggcatcaatcactgttgcgcggtgaaatgccacaaactatcgggggaggtattggtcagtcccgcttagtgatgttattgctgcagaaacaacatattggtcaggtgcaatgtggtgtttggggccctgaaatcagcgagaaagttgatggcctgctgtaaaatctagtcattatccccctatgctaactcgcgataacggtatcagtcatcgcgggtttttaactttatcagtctgtaggcggcatcactatgggggattatcgtttccagcggcgtatcaaacggctttttaaacttgtatcaaaacgccagatatgatcaaaaatacgcatgatccctggtttgccataagcggacatggcaacagcatggaaacggtgctggtgggcctgctgctggatttttatctttctgactaactcttctggcaaacgctgggcgataaagtctgaaatgatcaccgcgtctgcgtcataccattctctgtcttccattttatttaacgtgttggctaagcatgccgccagatccgtaccaccacgaaaatgttggttgaggaaacgtatggcttgctcaataccattgtcagctgatagctcgtagtgaattatttcagtagcaaataacatgatgtaacagcggcgattatcggctaacgcgatacggagtaaggccagacaaaatgctttggcgcattgctcgttgaagcctcccatcgagcctgaggtatcgacgcagacaataaatggcccacggggttgctcatcattttgtttaaggctgacgggtctctgttgcgttttttcctgccagttgtctccttgtaatcggtatgtgagcaaacgccgttccagtaagcggcgataaaactcaaactccaactcactcatccctaacatcaccaattcagtaggcaataatcgcaggatgtcattactctgatgaataccactgacctcctcaggcaccgaatctggctggcgtaccataacggtgtaaggctcatagcgggcgtcaggtgccggttgtgctttggctgagcggctgcggccgagctgttcggctaaacgtattaattcaggttgctgttgcagaaagtcgccatattgcagcaataattgataatcgccacgttgcaaatgcccctgactcatatcccaaagacgcccagcggcattgtcattggtggtgagaatgggttccagtgcaccactgagcgctaatcttcgctgtagctcagctaagagctgttcccgttcttgttctaacaactgatgatgaattgtgatggtttgtaggatcagactgacacgccaacgttgtaaaaagagcgtttgcaggctatctccgcctggcgggttttttgccaggtctgcggtttgcactaatgttttagcctgcgttgcaaacggggaatgtaaatcttgtaactgagccacgatatcgggcagatgcgcataaaactgtgggctatcctccaacagactctgttgatataaggaaaattcattcgccagccctggcggaacgctagcttcacggatccgttgttgcaaattttgtttccagccgggaatatctttcattaatgcccgtttaatccgcgggaatttttcaaaaaaaatcgccaactgaggtgctgccagtaaacctaccaccatctcttcgataagttcaccttcacttatcgacagcagcatatccagtgttgccagactgagcatcggtcagtgtccactgtgtttttgttgttgaaatttacgttgttgaaattgaatttgttgaaattgaagttgctccaccacctgtagcaggctggcctctatttttgccagccaagatgatggggtaaataaacaaggctgatgttggctaaataagcgccgttgttctgccagcgtactttccagtttggtgagtgccagcagcagttctggtggcacgctagtggttgtggcacccggaagggacaaggttgatggctggcggctcacatccagtatgattatatgtaactgatcatcaatttccgcatcgatagattgtgcatagccaacaccatttaatttggctcgtaaagcgccacctttattcagccattgagcaagggcctctttatcaacctgcagatgattgacctgaatatcatgtaagttaagcggtttttgcagtaatagcgtcaaggtactgtctgtcagattatccggcagagcatattgcgctttacggctgaacatgccgctttgcttaaccacagtgagtgcctggtggtcactttgctgctgttggtgttgcaaccatttgctattaatatcttgtagcttcattaataagctttgctgttgatacccttgttccgtcaacaattgttccagttgctgttgcagtaatttgaacgagttaaggtcatgccataggcaatctttcagtaaaatcagatcaataggggttatttcatcacggccactgaagaatgcactggcttgtagtagacgtaatgccttcttccagcggcggtcagagacataaggagcgtgttccagagcgctgagtcgttgacgtagctgaaaaataagctcaaagcagtgatctggtaatgtgattttgtcaatcaagggctgccactggtggaattcttcatcagtgatactgaggttttctgctaccgggttgtgattttcattttgtctgctgatcagcagtgagcggaaattctgtttttcttgtacccggtctagccacaggcggatcagcatccggtcataaagtgcttccaggctgctgtctgcgtctggcaactcattggacgcggttaccagcaagcgcatcgggatactgtcttccctatcaccatttcgaaagcgccgttcattaatggcggtcagtagagtattaaggatagccgggcccgccttccagatttcatcgaggaagacaatttcagcttctggtagataacccccggtcattcgttggtaacgcccttcttcttttaatgcctgtatggacagcgggccaaaaacctcttccggtgtagaaaagcgggtcatcaggtattcaaatgcccgagcatggcggaaagcaaatttcaagcggcgggcaatcaggcttttggcaattcccggaggaccaagcagaaatacactttcaccgctgagtgctgccagtaagcacaaacggatggcttcctgtctttcatacagcccactttcaagggcatgacttaagcgagatattctttctgccaattgcgatgattgcgccataattgttctacatgttcctctgatgagttaatttttacctgataaaacggaataaatcctctttttcttaataggatagcttgttgattagtgaaattttcatatcatcaattatttgtttttgattaaatatcgttctttttctgctctaatttaagagtaggcaatccatttaaataatgcatactgaacgcctttcgtgggcgtgaaaggacataggatcttctgtcatggggcctaaacgcatacatcagcttatggatgttctagcaaatgagcacagagcataaacaatctttatccgcggtgactttggctgcaatcggggtcgtttacggtgatattggcaccagcccactctataccttgagagagtgtttttctggtcattatggttttgatgtccgacccgatgtggtgtttggttttttatcgctgattttctggatgctaattctagtcgtctcggttaaatatctgacctatgtgatgcgggctgataacgcgggtgaaggagggattttaacgttgatgtctttggcagggcgtaatacctcttccagagcgacgtctatcttggtggtccttgggctaattggtggcagcttcttttatggtgaagtggtcattaccccggcaatctcggtgatgtcagctattgaagggttggaaatcgccgcacccgcccttgatccctacattgttccctgctccattgccgtattaacgctactttttgtgattcaaaagcatggcactggcagtgttggtaaacttttcgccccggtgatgctggtgtggttcctgacgttagccttacttggtctgcgcagtattattgctaacccagaagttttggccgcgctgaatcccaaatgggcaataagcttttttgttgaatataagtctgtttcgttttttgcccttggtgcggtagttctggcgattactggcgttgaggcgttgtatgcggatatggggcattttggtaagtttcctatccggctcgcttggtttactgtggtcttaccgtcgttggtgctgaattattttggtcagggggcgttattactgaaaaaccctgaagccatcaaaaaccccttctttctgctagcccccgactgggcactgattccattacttattctggcgacgctagccaccgttattgcctcacaggcggtgatttctggcgtattttcacttactcgacaggctgttcgtttagggtatttaccacccatgcgaattattcatacttcagagatggaatctggccagatatatatcccggtgatcaattggaccctctatttagcggtggtgttagtgattatcggttttgaacgctccagtaatttggcggcggcttatggaatagcggttaccgggactatggttatcaccagtattctgttttgtaccgtggcatggaaaaactggcattggaatcgctttctcgtcgcatttttactgatggtcttgttgattatcgatatcccgatgttttctgccaatgtgcttaaattattctcagggggttggttgccactgtctttaggtttggtgatgtttattattatgaccacctggaaaagtgagcgtttcagtttactgcgccgtatgcatgaacacagtaattcactggaagcgatgattgcttcactagagaagtcaccgccagtacgggtacccggtacggcggtgtatatgtcgcgagcaatgaatgtcattccatttgcattattacataaccttaaacataacaaagtgttacatgagcgtgttgtgttgctaacgatgcggactgacgatgtgccttatgtacataatgtggagcgggttaccatcgagcaactttctccaaccttctggcgggtggttgccagatacggttggcgtgaaacacctaatgtggcggaaattttccaccgttgtggtttggaaggtttgtcttgccagatgatggaaacgtcgttctttatgtcacatgaatcgctaatcctgactaagcggccatggcacttatttttacgtggtaagttatttattgcacttagccgtaatgcattacgcgcaccagatcaatttgagatcccacccaatagggttattgaacttgggacacaagtggaaatttaattgagaggccgttaatcataacggcctcttctatcatcattcacactattatcatcatccacactatcaccgctaaaatccttcttcttatatcgctagcaaagcgtttcggtggcgatcacaatttcactaaatgaggtttgtcttctactgccgtttttctaaactccttgttagcgaaacgtttcgctcttggagtagatcatgaaaaaaggtgtattactgaacgctgatatttccgcggttatctcccgtctgggccataccgatcagattgtgatcggtgacgcagggctaccgataccggcaaccaccacacgaatcgatttggcgttaacacgaggcgtgccagggtttctgcaggttgtcgatgtagtcacgcaagaaatgcaggttgagaatgcttaccttgcagaagaaatcgttaaaaataatccgcaacttcatgaagcattactcgtgctgctcacacagcttgagcaacggcaggaaaaccaaattgctttgcgttatatcagccatgaggcgtttaaagagcaaactaaacaaagccgggcggtgatacgcagcggagagtgttctccctttgctaatatcattctcggctccggcgtaaccttctaaggcctttatgcaacctttactaaaatttcaaggacaaaggaataaataagatggaaacaggtaagctggtggtgttgggcagtatcaatgccgaccatattctgaatattgagcagtttccacgtccgggtgaaacggtgatcgggcagcagtataacgttgctttcggaggtaaaggggctaatcaagcggttgctgctggccgtagcggtgcggatatcgcatttattgcctgtgtgggtgacgatgatattggtgaacgggtgcgtcagcaactcactgccgataagattgatactcagcctatcgaggctattaagggggcaactaccggtgtggcattgatcttcgtgaatagcgatggcgaaaatgtgattggtattaatgcgggggctaactcagcggtgacaccagagtatcttcgccgctaccaacaacaagtgatcgatgctgatgcactcttaatgcaactggagtcgccgctcgacactgttattgcggccgctaaactggcgaagcagcatcaaactcaggttatcctcaatccggcacccgcccgtaaattacccgatgaattattaactctggtcgatatgattacgcctaatgaaacggaagccgagcgtttgaccggcattcatattgagcaggatgatgatgccgcgaaagcagcgcaaattttgcatgataaaggcattgctaccgtgatcatcaccttaggtagtcgtggcgtatggctcagtgaacaaggtaaaggtaaattagtggcggggttcaaggtaaatgccgtagataccattgctgccggtgatacgtttaacggtgcattattgacagcgttattagaaggccagtctatggatgccgcagtgcgttttgctcatgccgcggcggctattgcggtcactcggcctggagcacagccgtccattccatggcgtgccgaaattgatagcttcttacaagaacgagtgtaaaacgtggccacaatgaaagatgtcgcccgtctggcaggggtatcgtcaggcaatggcacgtgcaggtttgccaattattgccgggtatgaagttgtcagtgattttgaatttggtggtggcctggttgccctgaagcaacgactaaataatccagaagctgagccacaagttctgcccctgactcccgagctaatagaacgcggttcggtctcccttcgttaaacattatttttcacctgtggggctacttttttcacattacggccctgaattaaattgtctccatccctgggtttgagtaacaagaacaccagagatgatagcaatgtcactattcccatggtgataaaggtgtagtggaagtgatccacattaccgcctaacgacaacccatcataaaaacgcaacacagtcgcactgatagcaatcccaaagcttatcgataattgttgggttaccgccagaacactgttgccggagctggcattgttatccgtcaaatcagccagtgtaattgtattcatcgcagtaaattgggtcgacatcgctatacctaatataaatagcggcaatatcatcatccatgccgacatccccggtgattgcaatgcaaaggaggcaatcagtaccccgataattaaggttataccgactaacactttacgatagcccagtgagcgcagcacctgtgtgacggctgattttgccatgatggatccaatcgcggtgggagccatcatacaaccggcgataagtgcggaataaccgaatccaacttgtaacatcaacggcattaaaaaaggtacacagcccgtccctaagcgggaggccacgttaccggcaatccccacggagaatgtccgggtcttaaataatggcaaaccaatgagtggattaggatggcctttggcatgaaatatatagaaaatcagcattaataggccgcctagcagagttgcggcgggtaaataatctgcgatttctggccgccccataatctccaggctggtggatatcatgactaaactgataccaaatagtaggaaaccaacaaaatcaaaagtgcgcttaggcatcgtgaaattaggcatatatttgcgggcataaaaaatacccaacaagccaataggaatattaaggataaaaatccaatgccaagtggtataagtcaccaacaacccgcccaataatggccccatgactggcccgactaaccctggaatagtgacaaaatttaaaaccggcaataactcactgcgtggataagcccggatgagcgccagcctggctaccggcatcatcatcgccccaccgatcccttgaataacccgagaagccactaagaaagccagtgagcctgaaagtgcacagagcagtgatccgaaggtaaataaagaaaccgccaggataaaaattcgtcgggtaccaaaacgatcggccagccaaccactaactggaatcaacatcgcgacggtcagggtatagctaataatggctgattgcattgtcagcggagaacggttaaggctttcggcgattgaagggagagccgtattcagtatggtggcatccaaagcctgcataaagaaagccatagccgctatccaaggaaggcctgccatactgcgcgcagattttatcattatccgtcctggtgatttatatggggggcgataattttctcttctttatatagatagcatgtggctgatcgtgctgtcgtcagtctaccgtttttaatagcacctgacaggcgaataaagcaccttgattatcacctgccagaatcgtatctacaatgttctgatgatgttgtagcttaatcacttcatcaccagtaatagcacgaaagtagctgtaataaaccgaactgaataagttagcaaaagagattaaaaatggattgccgctggcttcataaattaatttatgaaactgggtatccacctgaatccattgctcacgattaaagttgctatgcagtgcacgcatttctgcaactagtgatgctaacagctctcgctgtttctcattggcgtgtgtggcagccagataacaggcttgtggttccaacgatgttcttagtataaggaagtgttgcatgacctgatcaaaattctccttggtcatccaccacgttaataattcctgatcaaggtagttccaattcgtctgtggcataacacgagtgccaatacgcgggcgcggtaatagcatccccttcgctgccagcatttttactgcttcacgtactgcggtgcgacttacaccaaattgttcacccaactctatttcgccgggcagtatactgcccgcttcatattctcctgcgagaatacgctgaccaatcttttcagccagtaagtaggaaagatttcgctgggcggcttgctgttgggtatttagttgcatggtgatttgtcctatcagtcttcttatatttctattttactctactgtttcgcttcggtattggatgtttagcttaataattgtttaaggattgtcctttttctctgtttttgctgaaaaaaaacacggttgaaaagttttttgaaattaggggttgcaggctgtcaggaactccctataatgcgcctccactgaccgggaacaacgaaacacacttcgccgggtcaggaagagaaaagcagacttgaacttcgaaagaaataaaagaaaaccttgactcttcagcgggaaagcgtattatctgcctcccgcgttaccgtaagattcgccgcaaggcaaacgggtaacgaacgctctttaacaatttatcagacaatctgtgtgggcactcgcaagacgatatcgacgcctgtttcggcaggcagaaataatatcaagtcttgaagagtgaccaaagcagtaaacattgtgacttcggtcagaatgcctatttgcagaaagtaatctttgagcaccgctgcttttacgcaagtaaaagtcagcaaatcaaacaaatcttaaattgaagagtttgatcatggctcagattgaacgctggcggcaggcctaacacatgcaagtcgagcggcagcgggaagtagtttactactttgccggcgagcggcggacgggtgagtaatgtctggggatctgcctgatggagggggataactactggaaacggtagctaataccgcatgacctcgcaagagcaaagtgggggaccttagggcctcacgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggttgagtttaatacgctcaatcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaatttggcagagatgctaaagtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagccagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaacgatacgcattgcgcagtgcccacacagattgtctgatgaatgtaaacgagcaagagcacctgttgatgttatgagtttcgactcatgctgatacgaaacggttgaatttcggtttgatcggcattttcgtgtccccatcgtctagaggcctaggacactgccctttcacggctgtaacaggggttcgaatccccttggggacgccaatccgataatgagtgaaagacattatcaccggttctttatgaactgaaaaataacgtaaagatgactttaccaagtcgtgtttacgatattgctctttaacaatctggaacaagctgaaaattgaaacattacagctgaaatttaccccgccgtagatgtattggggtaaagagtaacctgtaatagagtctctcaaataatcgcaacacaagatgtactgtcagcaatgataagacaccttcgggttgtgaggttaagcgactaagcgtacacggtggatgcctaggcagtcagaggcgatgaagggcgtgctaatctgcgaaaagcgtcggtaagctgatatgaagcgttataaccgacgatacccgaatggggaaacccagtgcaatacgttgcactatcgttagatgaatacatagtctaacgaggcgaaccgggggaactgaaacatctaagtaccccgaggaaaagaaatcaaccgagattcccccagtagcggcgagcgaacggggaggagcccagagtctgaatcagtttgtgtgttagtggaagcgtctggaaagtcgcacggtacagggtgatagtcccgtacaccaaaatgcacaggctgtgaactcgatgagtagggcgggacacgtgacatcctgtctgaatatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagcaccttcgtggtgtgactgcgtaccttttgtataatgggtcagcgacttatattttgtagcaaggttaaccgaataggggagccgtagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatcttcgggggtagagcactgtttcggctagggggccatcccggcttaccaaaccgatgcaaactccgaataccgaagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacacttaggtgttgttgggtaggggagcgttctgtaagccgttgaaggtgacctgtgagggttgctggaggtatcagaagtgcgaatgctgacataagtaacgataatgcgggtgaaaaacccgcacgccggaagaccaagggttcctgtccaacgttaatcggggcagggtgagtcgacccctaaggcgaggctgaaaagcgtagtcgatgggaaacaggttaatattcctgtacttggtgttactgcgaaggggggacggagaaggctaggctggccgggcgacggttgtcccggtttaagcgtgtagggggagtgaccaggtaaatccggttgcttatcaaccctgaggcgtgatgacgatgcactacggtgcagaagcagttgatgccatgcttccaggaaaagcctctaagcatcaggtaacattaaatcgtaccccaaaccgacacaggtggtcaggtagagaatactcaggcgcttgagagaactcgggtgaaggaactaggcaaaatggtgccgtaacttcgggagaaggcacgctggcgttaggtgaaaggactagctcctggagctgaagccagtcgcagataccagctggctgcaactgtttaataaaaacacagcactgtgcaaacacgaaagtggacgtatacggtgtgacgcctgcccggtgctggaaggttaattgatggggtcagccgcaaggcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggccttgaagtgtggacgccagtctgcatggagccaaccttgaaataccaccctttaatgtttgatgttctaactcggccccataatctggggtgaggacagtgtctggtgggtagtttgactggggcggtctcctcccaaagagtaacggaggagcacgaaggttagctaatcacggtcggacatcgtgaggttagtgcaaaggcataagctagcttgactgcgagagtgacggctcgagcaggtacgaaagtaggtcttagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggaagattgagaggggctgctcctagtacgagaggaccggagtggacgaatcactggtgttcgggttgtcatgccaatggcattgcccggtagctaaattcggaagagataaccgctgaaagcatctaagcgggaaacttgcctcgagatgagtcttccctggggcttaaagccccctgaaggaacgttaaagactatgacgttgataggctgggtgtgtaagtgcagcgatgtattgagctaaccagtactaatgatccgtgaggcttaaccttacaacaccgaaggtgttttgaattgagagagattttcagcgtcgttccgagattggattgactggcgtcacaagcgttgtttgtgtgcgggttaattaaaacagaatttgcctggcggccatagcgcggtggtcccacctgatcccatgccgaactcagaagtgaaacgccgtagcgccgatggtagtgtggggtctccccatgcgagagtaggacactgccaggcatcaaataaagccaagaccccatgcccaaagcgtggggtttttgctgtgtgcgaaacacagaaattacgcgttttactgataaccccatgccaaaggcgtggggtttttgctgtgcgcgaaacacagaaattacgcgttgtaatgatgattaaaatggtgaggataaggtaggttagcaacgtgtccacaccaatgatggcgtagctcgagcctatatggagcaggaaaaacggtatttttactggctgcctattctcttcgccgcgggcatttggtcatcaacctcagaaacttcactttttgtgatagatattctcttctccctactgttttgttcgtcgtgggccctaagtgaagagactgtgggtataatcgattaccgggagaagcggtatggcggcgtatggctatggtccagcacgattaattcataccactacgattaaattaatactatatcggtaaatattattaattatggatagtgcctttgtagagactgtaaacaatattgtgtaattgcctgtttttgatatcttcactccaacaacggagacaggcaaattatggacgaaaagaaacttaaagcacttgcggctgaactggctaaaggtcttaaaaccgaagccgaccttaatgcattttctcgtatgctgacaaagcttaccgtcgaaacagcgttaaatgcagagcttaccgaacacctcgggcacgagaaaaacacccctaaatcaggctcgaatacccgcaacggctattcgtccaaaacactgctatgcgacgacggcgaaattgagctgaatacgccacgcgaccgcgaaaacacctttgaaccgcagctgataaagaaaaatcagacgcgtatcacacagatggacagccagattttgtccctgtacgccaaaagcatgaccacccgcgaaatcgtcgccaccttcaaagagatgtatgacgccgatgtgtctcccacgctgatatctaaagtcaccgatgccgtaaaagagcaggttgctgaatggcaaaaccgccaactggatgctctgtatcccattgtttatatggactgcattgtcgtaaaagtccgccagaacggtagcgtgataaacaaagcagtgttcctagcgctgggcatcaacactgaaggtcagaaagagctgctgggcatgtggctggcagaaaatgaaggtgcgaagttctggctaagtgtgctgacagagctgaaaaatcgcggtcttcaggacattctgattgcctgcgtggatggcctgaaggggttcccggatgcgataaacagtgtttatccgcagactcacatccagctgtgcatcatccatatggtacgcaacagcctgaaatatgtgtcatggaaggactataaagccgtcaccagcggtttgaaaatggtgtatcaggctccgacagaagaggcggcgctgatggcgctggataagtttgcggaggcctgggacgacaaatacccgcaaattagcaaaagttggcgtacgcactgggaaaatctcaatacattcttcggctatccgcccgatatccgcaaggctatctacaccacgaatgccatcgaatcggtgaacagcgtgatccgtgcagccattaaaaagcgcaaagtgttcccgacagacgactcagtgcggaaggttgtttatttggcgatcaaggatgcatcaaaaaaaatggagtatgccgatccagaactggcggttagcgatgagccgttttattatcgagttcggtgaccgcctgagcgatcacctttaatacggtggcagttacacagaattatggacaggctcattttgtatgactacccccgcattaccttacttcaaaactaatattttctaaccaggtgcagataaactccgtaatctgttcgggctgattaatatccaattgttttaccgtcgtctctattggcttatcacttgccagagcaataacgtgtttatcgatcaaaccagagaaaggtttaccgatggattctctatagagtgcaattttattgattggctcatgcttaaagccttcaactaatattaagtctatcgtagaggcatctaatcggctggcaagataatgaagatttaacggctgttgttctggggtttctgtcattagtgcccaacggcaatcactggcgaccagtgtttgtagcgctccagccttacgtaattcgtagctatctttgcctggggtatcgatttccatattatggtgagtatgtttgattaagccgactcgaacttgtcgctgttgcagtagaggaataagactttttaataaagtcgtttttcctgtaccactataagccgctattcctaatagcggcggtgacttgtagttcatcattggcctcttctcttttgttcccataaatcacaatctgctggggtatttaggttgctgaataaatcagccttcccgctaaattttacacgttgagcattaatagagtctaaaaataacataagcttacggtcaccccttatcagatagtcagctaattgtgtttttaggctgatatgcatcaatgcgaaagtgggatgtgctctttcatcatcgttagcataagccgcaagtgcctgttttttaccttgccaaagctgagaaactaaatcggaaggcagtgcgggaacgtcgcagggagcaaaaacgacccactcggtagacgcatagcttaatccggcatgcatccccgccagtgggccctacaaagccagtaatgatatcgtcaatgactgggattccactttccttatataacccttggttgcgattagcattaatcactaaatcactcacttggggtttgaatctgtctataacatactgaaatagcggttttccattaagaggaataagtcccttatcattaccgcccattctggacgaacggccccctgcgagaataacacctgtaatattgggttgcatttctatcgctccgctgcatcctattgacacagggattgtatctgtaaataacataggggttcaggatttacttttattgacaataggctctctttccctacgtgagtatccctgctactttgtcagcatctttttgaagaggataaatttgctatgaaatgccatcgtgttaatgaattgattgagcttttacatccagcttggcagcaggagcctgatttaaacttggtacaatttttacaaaaattggcggcagaagcgggttttaagggggatttttcggatttaacggacgatgttcttatctatcatctgaaaatgcggggcgctgcatcaaccgaggtgatccctggcctgaaaaaagattatgaagaagattttaaaacagcactgttgcgtgctcgtggcattattaaagattagtcatactcctgtctgcggagataggggctttaatgatattatttattattctcagcgcgctgctgtcacttatatagactaaatgttgttatgaacaactctgcttttaattttcagaccttgtctcctgacctgattatggatgcccttgagggggcaggattacgggtagattcggggttaaccgcgctgaatagttacgaaaaccgtgtctaccagtttatggatgaagagagtaaacggtatgtggtgaagttttatcgccccgagcgttggagtagtgaacaaattacagaggagcaccagttttctctggatttggcggagtcagaaattccggtgattgccccattgcgactcaatggcaagactttgcatactcactgtggatttttcttcgctgtttttcctagcgttggtgggcgtcagtatgaaattgataatcttgaccaattggagtgggttgggcgttttcttggcagaatccatcaggccgctcgtaatagccttttcgttgcccgcccaacaatgggtatagaagagtatttgacagagccgcgtcagctactcgccaattgtgatttagtaccagtaaaacaacgggataaatttctggcagcggcagatttgctcattacaacgattaagcagtattggcatacagaatggcagcctttacggctacatggtgattgccatccaggaaatattttgtggcgtgatggtccgatgttcgttgatttagatgatgcgaggaatggcccggctatccaagatttatggatgctattacacggtgatcgccgtgaccaatctatgcagttggatatattgctggaagcttatagtgagtttgctgattttgatcagcgtgaattagcactaattgaacccttgcgcgcgatgcggatggtttactaccttgcatgggtcgccagacgttggcaagaccctgcatttccgaaaagttttccgtggatggctgaatctgatttttggctccagcagacagcatcattcactgagcaggttaagctgttgcaggaaccccctttgcagctgatgccaatgtactaaagctaagataatggagattgttatagtatgaaaaatgtatggttagcactcgttggtatcgtgatggcgttcagtgtgacggctgcacaattcaccgatgggaagcagtatctaacgttagataagccagtaacgggtgaacctcaggttctagagtttttctctttctattgcccacattgttaccagtttgaagaggtttatcaggtacctaaagcagtaaaaaaagcgctacctgaagggacaaaaatgacccgttaccacgttgaatttcttggtcctctcggcaagcaactgacgcaagcgtgggctgtcgctatggcattgggggttgaagaaaaaattaccccactgatgtttgaaggtgtgcagaagacacaaactgtacagactcctggcgatattcgtaatgtctttatcaaggcgggtatcagtggtgaagactacgacgctgcattgaatagttttgtggttaaatcattagttgctcagcaacaaaaagcggctgaagatttacaactacgtggtgttcctgcgatgtttgttaatggaaaatatatgattaagaatgatggtatggataccagctcaatggataattatgttaaacagtatgcggatgttgttacattcctgctgactcaaaaataatttagtacataaagagggggcttttgttgcccctttttttatttatttttatgctgtttagcttggatttatctattttagggagcaatagatatcaatattcgtgggactaaaaatagatattgtcggttatgagtaataaaaaagacagtcgctattgagtactcataaggcaagttaattggccttgttgttgtaatggaataagtaatatccacaattgatataaataaattattacagagaaaaaagatacaaataaacctaacattatgatttatatgcttttaaatataaccatcggcatgattccataacagaaataattcacacatacttttattcacaagattatccacaggttagatctttaggatctctgtgcggtaatgttcactttcgcacaatattggacgctaaaattcgtctcttgctgtcagctatggcattcttagcgtcagactttgctgaatacagatgaagaaactctatggctcagattgcagaaaacccattgatccttgttgacggttcctcttacctctaccgtgcttaccatgctttcccaccactgactaatggtagcggggagccaaccggtgcgatgtatggcgttctgaacatgctacgcagtctgctgctgcaatatcgaccaagtcatgttgcagtagtttttgatgcaaaaggtaaaacgttccgtgatgaactttttgctgaatataaatcccaccgaccgccaatgccggatgatttacgggtgcaaattgaacctcttcatcagatggttaaagcgatgggattgcctttattggtcgtttctggcgtcgaagctgatgatgttattggcaccctagctcgggaagccgaaaaagcaggccattcggtattaatcagtactggtgataaagacatggcgcaattagttacgccgaatatcactttgatcaataccatgaataacactattttagggccgcaggatgtttgcgataaatatggtgtccctcccgaactgatcattgattttctcgctctgatgggtgactcctccgataatattccgggagtacctggtgttggcgaaaaaacagcacaggctttattgcaaggtttgggtgggttggatacgttattcagtaatctggataaaatatcaaccttgacgttccgtggtgcgaaaacaatgtcggccaagctagagcaaaataaagacgttgcttatctctcctataaattggctactatcaagacagacgttgagttagatgtaacctgtgatgagctaaccgtttctcctcccgatgataaacagttacatcagttattcagtcgttatgaatttaagcgttggctggctgatgtcgaagccggcaaatggttggacagtaaaaaagatcggccaacagggcaaacaagcagtcaatcttttgttgccgcagatacggcccctactgctgaagtcaccgcagtgctttcacaagagaattaccagactattttagatgagaaagcattggctgattggattgagcgccttaaagccgctgaagtttttgcttttgatactgaaactgatggccttgatacccttagctgtaacttaattgggatgtcttttgctgtcgctccaggtgaagcggcttatctgcctctggctcatgattacctggatgccccgccccaacttgaccgtgactgggttctggcgaccctgaaaccacttctggaagacgataaggcgcttaaagttgggcagaacctcaagttcgataaaagtatgctggctcgttatggtatcgatctaaaaggtatcgctttcgataccatgctggagtcttatgttttggatagtgttgcgggccgtcatgatatggacagcttggcggagcgctacctcaatcataaaacgattacgtttgaagagattgccggtaaaggtaaaaatcagctaacgtttaatcagattgcgttggagcaagctggcccgtatgccgcagaggatgccgatgttacccttcaattacatttggtcttatggccaaaattacagcaaagtgaaggcctcaagcgggtattccaagaaattgagatgccgttattgccgatcttgtctcgtattgagcggactggcgtattgattgaccaaaatatattagcggcacactcaaaagagctcaccatccgtttggatgagctggaaaagcaggcccatgaattggctgaagagccattcaacctggcatcacctaaacagctacaggctattctttatgaaaagcaaaaattgcctatcttgaagaaaacacctggaggcgcggcgtcaacgaatgaggaagtgctggctgagttggctctggattatcctttgccgaaggtgattctggaatatcgtggtctggcgaaactaaaaagcacttacaccgacaaattgccgctaatgattaaccccgtctccggtcgggtacacacttcctatcatcaggcagtgacagcaaccgggcgcttgtcttcccgcgatcctaacctacaaaatatccctgtacgtaatgaagaggggcgacgtattcgccaggcctttattgcaccgaagggctactgcattatggcggccgactattcgcaaattgaactgcgtattatggcgcatttgtcgcaggataacgggctgttagctgcatttgctgctgggcaggatattcaccgggcaaccgccgcggaagtatttggttcgccattggaaaaagtgacgacggagcagcgtcgtagcgcaaaagcgattaattttggtttgatttatggcatgagtgcttttggcttggcacgccagttggggatccctcgtggagaggctcaacgttatatggatctctattttgagcgttatccgggggtgttggagtatatggagcgtactcgtaaacaggctgctgagcagggctatgtcacgacactggatggtcgccgcctctatctgccggatattcactcacggaatgcaaaccgtcgaaaagcggctgaacgtgaggcgattaatgcccctatgcaaggtacggctgcggatattatcaagcgggcgatgattgcggtggatggttggttacagcaagagccagaaccgttggtgcgtgtcatcatgcaagtacacgatgaattggtctttgaagtgcatgaaagtgttttgcaaagtgctgagcagaaaatccgtgagttgatggagaaaagtatgcaactggctgtgccattgaaggtggatgtcggtgttggcgctaactgggatcaagctcattagtgatgtgggtaagtggcgataaacaaagcgttttttgtaattaagctacatttatgggctaatttacctgaaatagctctgctgaatcgtgacaatttgtgtaactaaacaacaaaaatttcttttgccctgcgaaaaaatgatgtagagttatagacgtagggtacagaggtaagatgttctatctttcagaccttttacttcacgtaatcggatttggctgtatattagccgccccagtcatttattgactggggcgttttttatggggattttgctgacattattggcgtaactgctgggctggtaggtgctcatcaggcgggtaactgtgcaggaaatggtaagtcttataatgcagggcgacattaatcatcgcccttgtctgggctgctttttacaataaattactcgccttcgccgtcaaactcttcagccataacttctggtgggatctcactaaaccaggtgtccagtttttcccgtaacttatcgacaccaatctttttcagtgatgagaatgcctcgacctgaatatcacccataaatgggatgatagcttcccgcaccagatttaattgtgctttacgcgcaccggatgccagcttatccgctttggtcaacagcaaaagaaccggtgtaccgaccgcgaccgcccaggtaatcatctgctgatccaaatctttcaatggatgacgaatatccatcagcacaactaatcctttcagacaattacgcttctgcaaatattcacccagcgcacgttgccacttgagtttcatctcctcaggcacttcggcatagccataacctggtaagtccactagacggacaccatcaaccacttcaaacaggttaattagctgagttcgccccggtgttttactggttctggctaaacctttttggttagttaatgtattgagtgcactggatttacccgcgtttgagcggcccgcgaatgcgacttcaataccttcatcccgtggtaggtgacgaatatccggagcactgatgacgaagtgagtcatatgatagttatagtttctgatggtcaaaatttgtcgtctccgttagagattacttatatagggcgattataactgcatcaggcagaaaaaagggggtttatcttttggccccgtttttaattgtttctttaagtgaaattatagttttgtgagtcgtcggtcattgtgggcggcgataatgtcttatcatttagctactgttaagaaatacttgataaaaaatgggctattatgcacagctctctgattagttttaattgagtttgttgaacaaaagcaatcagctagtcaatttgttattggtacggatacaccatgcaaggagcacagttactcaggatgagtggcttatgtttaaggaacgtaatggatatacaaggaacgtaatggatatacaaggaatgtaatggatgtacgggagccaaggatgctataaacggagctaatgtaaagggatgttcaggacattggccggagcgccgggcgaatcgccttcagggtttgaggggtggcaaggatcgcgtattgcaggagggagaaaccgggacgttatctaagtgcagggagtgcgctgtaaggatatccttccgcagaaggtgcgaaaaaaggcgacaggttaacctgccgccttttttctttctcttctttctgctagattccggcccaatcctatacccaatagattttaagatgcaggaaggcggcaaacgagagcggccaacacatctgcaacttggacggtggcgggtatatactaaatccgatcccatactcatttaagagcacaggttatgaagcagccaaataaagcaccacgcgcgaatattgcggccccgaagggtacagcaacaccaaaacgtagaagaaagacccgtgatgagctggatgctgaagcacgtgaccgtaaacgtcagaagaaacacagtggcaatcgctcaggtgcgagaaccaatgttgagggcagcaataagaaagggcatagccagactcaagagaaagatccgcgtgtcggtagtaaagtgcctgtaccgctggtcattgagagccaggtcaaagccaagtcaatgcctaagcctgtagagaaaaatgtggttaagccacgcctgacgccggaagaagagctagccaagctggagaatgacgaacgtctggatgcgctgcttgatcgtctggataatgacgaagtattgaacaaagaagaccaggcctatgtcgatctgacattagaccgtattgatgccctgatggagcaattaggcatcgaactgggtgatgacgaagatgatgttgagcgagaagagaagcaggaagatatcttgcagctactgaaacgtggtaatccaaaagatacattttaattaagtcatgaactgggtggtcccactaatagccctactactcacgtgttatctattgtggttattaggtaaactatggcggctgtcgcaacgcaaatcacggttgcgcagtgctactgcggtcagacaacaaaaacatctgccctctaaccgacccggtaggcgaaaatatcggaaggagtgaacatgtctgagcacgctatagtttgggatctatccctgattcaaaaatataattattcagggccgcgttatacctcgtatccaacggctcttgagtttagtgaagattacaatgagtctgctttccagcaggcggtgaaacgttatccgcaacggccattgtcgctgtatgtgcatattccgttttgccacaaactttgctacttctgtggctgcaataaactggtgacgcgtcagcaacataaagctgatgaatatctggtggtgttggaaaaagagatccgccagcgggccgccttgtttaccgggcgtcaggtcagccagatgcactggggggggggtacgccaacctatctgaataaaacgcaaatcagccatttaatgacggtgctgcgtgaacactttgattttctgcccgatgcggagcagtcaatcgaagttgacccccgtgaaattgaattagatgtgcttgatcacctgcgtgctgaagggtttaatcgcctgagcatgggggtgcaggatttcaataaagaggtgcagcggctggttaaccgcgagcaagatgaagattttatcttcgctttaattgcccgagctaaagcgcttggatttaactcaaccaatattgatttgatttatggcttgcccaagcagacaccagaaagttttgctttcaccttaaaacgggttgctgagctgaacccagatcgcttaagcgtgtttaattacgcccatctgccaagcctgtttgccgcccaacgtaaaatcaaagacgctgatctgccaacggcggagcaacggttggatattttgcagcacaccatccgtttcttaacggagtctggctatcaattcattgggatggatcattttgcgcgtccggatgatgaactggcaattgctcagcaggaaggaacattacaccgcaactttcaagggtataccacgcagggtgagagcgatctccttgggttgggggtttctgctatcagcatgttaggtgacagctacgctcagaatgaaaaagatctggaaacatattacgcctgtgtagagcaacggggtaatgcgttgtggcgcggcctgactatgaccgaagacgattgtttacgccgagatgtgattaaaacgctgatttgtcatttccaactcagttaccagccgattgagcagcgttatggtattcggtttgccgattattttgccgaagattttgagctgcttgcaccttttgaacaggatgggctggtggagcgaaatgaaacagggcttcgcgtgaccccccgtgggcgcttactcattcgtaatatttgtatgtgtttcgatatctatttacgtaaacaggcgcgcaagcagcaattctcacgtgtaatctgacgatatcaccctcagtgcggttatcgctcttgagggtgaccatctggcgggaactactccatccccaactctttcaacttccgcgttaatgtattacggccccagcccagcaggcgtgctgcttcctgcttatggccttgggtatggcgtaatgcggtggttaacagcgtgcgctccatttctggttgtgcttcagacagtaaatcctgatgaccagaacgcaacgcacgatccgcccattgcgctaacagcgttgaccaactgtcgggggctcgttggccggatgcatcgggcatatgagtttcaaataattcagacggcagatcctgaacgaggacttcctgcccagcggccatgacggtcagccaacgacaggtattctccagttggcgcacgttcccaggccaaggtaagcgggttagcgccgcttcggtctctggatgcagatttttgctttccacgcccaactctttagccgctacgtgtaaaaagtagcgagccaaacgcggaatatcctcactgcgttcacgtagtggaggtaaatgtactcggatcacattcagacgatggaatagatcctcacggaattttccttcttgaacacgcaactccagattctggtgagttgccgcaatgatccgcacatcgactttaacgggtgcatagcccccgacccgatagaactggccatcagccaatacccgtaacaggcgggtttgcacatccagtggcatatcaccaatttcatctaaaaaaagtgtgccggtgtcagcttgttcaaagcgcccctgccgtacctgattggccccggtaaatgcccctttttcgtgaccgaacagttccgactcaattaaatctttcgggatagccgccatgttcagtgcgataaagggggctttagcccgtgggctgtggcgatgtaatgcgtgtgcgaccagctctttaccggtaccggattcaccattaatcagtacgctaattgaggagcgtgacaagcggccaatgatacgaaaaacatcctgcatcgccggtgcttcgccgataatatcggctgtcggcccactgactggttggctacgggcgggttgttgttgctcctgataatggctaatagcccgttcaaccagagccacggcctcgtcgatatcaaacggtttgggcaaatagtcaaaggccccttgctgatacgcactgacggcggcatctaaatctgaatgggccgtcattatgatgaccgggagcatcggatggcgttgcttaatttgtttgagtaatgccaagccatccattcctggcatacggatatctgataacaacacatctggagttcgcgtagccagtgcatccaatacctgattgccgctatcgaatgcgacacagtttagacccgctccagtcagtgcgcgctcaagcacccagcggatggaactatcgtcatcgacgatccagactatccctcgttgcatagaaacctcactggcgaataggcaggtaaaccgaaaactcggtgtgtcctggccaactgttaaattcaattttacccgaatgctgatcgataagattacgggcgatagataaaccaagacccgtaccgccctcgcggccactgaccatcggatagaatacggtatcttgtaattgcgttggtacaccgggaccgtcatcttcaatatcaatccgagcggctaaacggtagcgcatgccatgtagcgtcacttggaaagcggttcgggtgcgaagtgtaattgtgccgccagtctccccgagagcctgtaatgcgttacgggtgatattcagcagcacttgttctatttggtctggatcatgggcaagctcagggaggcttggatcatagtcgcggattaacgtgacgttatctggtttttccaatgagactaattggcaaacccgctcagcaacctgatgaatactctgtgtaatatgttggccaggccgctgtgggcctaacaagcgatcaactaaattacgtaggcgatccgcctgttcaataatcacttgggtatattccagcaacgctggatcgggtaacgctttagctaataattgcgcagcgccccgtaggcctccgagtgggtttttaatctcgtgagccaatccgcgcactaaatcacgtgcggcaacttgttgagcgtgttgcaattgctcttggcttaaccggcgctgattatccatcggggctaattctagcagaataaacccttccgctagggactgtgcggtcagcgataaaatatgtgcccggccatcaacaactaatgtcacttcgttatcagtaaacccttgcccggcttgcaaactctctcgcatcaacacgatattcagtgaaaaatagcctaataaatcaggcagaggtgtaccaaaaagtttacgggagctttgcgccagaagttgctgggctgcggggttggcataatgaatagccaaatcatcatctaacagcagaatgctattaatgagagtattgaggatctgcccagcatcgggcagcgtgcctgttgccataatgcagactcctgcacagtttcggtgcatttatacccttcatctgtagggtatgtttctattcggtccatcctattggttccgttgcaatagaatcaaggggatgatgacgaaaacgaaaagtggagaaaaaagcccatcctaagatgggccaaaagtttccacggcaacaacctttcatctttcaagttgtcggtgtgttggctgctttcgctcgccgctttcctacaccttgaaatctattaggtaaatttaaacgctgtaatacagttcgaactcaacaggatgcggagtcatacgcacgcgatccatttcttctctacgtagctcgatatacgcatcgatagcatcatcggtgaacacgccaccacgagtcaggaactcgcgatcttcgttcaatgcggccatggcttcgtccagtgaaccggcaacttttggaatctcagcttcttcttccggcggcaagtcatacaggtttttgtccatcgcatcacctgggtgaattttgttgatgatgccatcaaggccagccatcaacagcgcggcgaagcacaggtacgggttagccgcaggatcggggaaacgcgcttcaatacgacgagctttcgggctggcaacaacaggaatacggatagaagctgaacggttacgggctgaatatgccagcatgaccggtgcttcataacctgggaccagacgcttgtaggagttggtggtcgggttagccaaggcattaatggctttcgcatgtttgatgataccgccgatgtagaacagggcgatttcagacaggccgccgtatttgtcgccagcgaacaggttattaccgttcttggacaaagacatatggcagtgcatacctgagccgttatcgccgaacatcggttttggcataaaggtcgctgttttaccaaatgcgtgcgccacgttgtgtacgacgtatttgtaaatctggatctcatctgctttcttggtcatggtattgaagcgggtagccacttcgttttgacccgcggtagccacttcgtggtggtgtgcttctaccaccaagcccatctcttccatcgtcagacacatggcagaacggaggtcttgtgcagagtcgaccggaggaacagggaagtaaccgccttttactgcaggacggtggcctttgttgccgccttcgtatttggtgctggagttccatgcgccttcgacgtcatcgatggatacgtgtgacccattgatgctgctaccaaaacggatatcgtcaaacaggaagaattctggttctggcccgaacaacacggtatcagcgatacctgaagatttcaggaagtcttcagcacgtttggagatagaacgtggatcgcggtcatagccctgcatggtgcctggctcaagaatgtcacaacggataatcagtgttgaatctgcgaagaacgggtccataacggcagtgctggcgtctggcatcagtaccatgtcggattcgttaatgcctttccagccaccaatcgaggagccatcaaacattttgccttcttcgaagaagtcagcgttgacttgatgagcagggatcgtgatgtgctgctctttccctttggtatcagtgaaacgtaaatcaacaaatttcacttcgtgctcattcagcatcgtcaaaacatgttcagcggacatacttatatctcccggatttgtcatagtcgtcgtcgtggaacgattaccgtgtgttactgcatttatggtgttcaggcattttgccggtaaaaagctctttcaaaaaaggccacttcaaaaacgttttacctggaacgatgccgccataaaaatcatcaggccataaatcgtgtcgcgctaaatactcatctcaggatccatgccaaagattcaagcgagcgatccatgctaaagcgattcgtgataaagctattcatgataaaatacgttgcgaaatctatgccaactttccaaaccccccatttatgccatatcatggggggtctgctgataatcagtatgcaccaggatagttatattgcactattttggtgcctcatttgcgccgttgggcactattttggtgcagggatgggccgaaaggctatttttgcaccgtgaaagggatcacaaacacaccgccgtcaggttgtttataagagaattttgtgatcttgtttagtccctcgcttaatacgtgtacaatagcgcgctatttctaaatgcctgaggcaaaaaagctgtgatcgagaatctgcgtaacatcgccattattgcgcacgttgaccatgggaaaactaccctggttgataagttgctacaacaatctggtactttcggtgaacgtactgaagcaactgaacgtgtaatggactccaacgatttggagaaagagcgtgggataaccatcctcgcaaaaaatactgccattaattggaaagactaccgcatcaacatcgttgataccccagggcacgccgatttcggcggtgaggttgagcgtgtaatgtctatggttgactctgtgctgttggtcgtcgacgcaatggatggcccaatgccgcagacccgtttcgtgaccaaaaaagcctttgctcatggtctgaaacctatcgtggttatcaacaaagttgaccgtcctggcgcgcgccctgactgggttgtggatcaggtgtttgacctgttcgttaacctggatgcgaccgacgaacaactggacttccctatcatctatgcatctgcattgatgggtatcgcgggtgaagaccacaatgatatggcagaggatatgaccccgctgtatcaggcgattattgaccatgttcctgctcctgatgtagacagttctggtccgttgcagatgcaaatctcccaactggattacaacaactacgtgggtgtcatcggtatcggccggatcaaacgtggtattgttaagcctaatcagcaagttactgttatcgatagcgaaggtaagacccgcaacggtaaagtgggcaaagtactgggccatatgggtctggaacgaatcgaaactactcaggcagaagctggcgacatcgttgctatcaccggcctgggcgagttgaacatctctgacactatctgtgatgtgaatgcggttgaagcattgccaccactgtctgttgatgaaccaacggtaaccatgtatttctgcgttaacacctctccgttctgtggtaaagaaggtaagtatgtgacttcacgtcagattcttgaccgtctgaacaaagagttgatccataacgtagctctacgtgttgaagaaacggaagatgctgatgcattccgtgtatcaggccgtggtgaacttcacctgtcagttctgatcgaaaacatgcgtcgtgaaggtttcgagctggctgtttctcgtcctaaagttatcaaccgtattatcgacggtcgcaatcaagaaccttttgaaagcgtaacgctggatatcgaagagcagcaccagggcgcagtaatgcaagccatgggtgagcgtaaaggtgacgtgaaggacatgatcccagacggcaaaggtcgtattcgtctggattatatgatcccaagccgtggcctgattggcttccgtactgaattcatgaccatgacttctggtaccggcctgctgtactccacattcagtcattatgatgatgtgcgtccaggtgatatcggccaacgccaaaacggtgtgctgatctctaatggtcagggtaaagcggttgcgttcgccttgtacaaactgcaagaccgcggcaagctgttcatcggtcacggtacagaagtgtatgaaggccagatcatcggtattcactcacgttctaatgacctgacggtaaactgcctgacaggtaagcagctgactaacatgcgtgcatccggtactgacgaagcaaccactttggttcctttcctcaagaaaacgttggaacaggcactggaattcatcgatgacgatgaattggtagaagttaccccgcaatcaatccgtatccgtaagcgtcacctgacggaaaacgatcgtaagcgtgctggacgtggtccaagagaaggttaattcttctttgcattgttgatacttagggcgctcaaggcgccctgagttcttactcctcctatcctctgcgtccttgaagttgtaacggtattaatttcactgacccactgacgtatataaactcatcggcgttttgttcacttgctgcagctgcaattttaggtgacggcgacaaatgcctttgaaaagacttcctgtttttttgccattactgtaaaaaatattatttttcctgtctgaaccctcctttttctccctctccctattcagtcttatcttttcccgctacagtgaaactcaccatctaattgggagagcgttatgctgtatatctttgatctagggaatgtgattgttgatatcgacttcaaacgtgttttaggtgtttggagcaaattaagcagtgttccgttggctacattgaacgagcgttttacgatgggagaggtatttcagcaacatgagcgtggtgaaatcagcgacgaggattttgcccaccagctcagtgatgaaatggggatatccttgagtttcgagcagttcgctgagggttggcaggcgatattcgtcgctttgcggccagaagttattgatataatgaataaattgcgtcgtgaagggaatcgtgttgttgtgttatcgaataccaaccgcttacattgttattactggccagagcactatcctgaagtcgctgctgctgctgatcacatgtatttgtcacaggatttgggaatgcgtaaaccggaggccagaatttatcagcatgtactgaatgctgaaaatgtaccggcagagcaggccgtgttctttgacgatgtcgaagcgaatgtactcgccgccaaggctgttggtataaatgctattcacgtcaccgatagacaaattattcctacttatttttccttataatttcgtgctctaatcattaatgggttagccttagtcgtgctaacccttatcacgctggcccaccccgagctttatcgtgttgacagagagacgaatatggcaagtttccggcgttttcgcttactttcccccttaaaaccctgtgtcacttttgggcggatgctgtacacccgaattgataaagatggtctgacgatgctggccgggcatttggcctatgtttcgttgctctctttggtccccttgattacggtgatttttgcgttattcgctgctttcccgatgtttgctgagatcagcataaagttaaaagcctttatatttgctaactttatgcctgccacgggtgacatcatccaaaattatcttgagcagtttgtcgccaactccaatcgtatgaccgtggtaggcacttgtggtctgatcgtcaccgcgttattactgatttactccgtcgatagtgtgctcaatattatttggcgcagtaaaattcagcgctcactggtcttttcatttgcagtttattggatggtattgacgctggggccgatcctggtgggggccagcatggttatcagttcgtatttactgtcactacactggctggcacacgccagggtagatagcatgatcgatgagatattacgggtatttccgttattgatctcctgggtttctttttggctattgtatagcgtggtgcccacggtacgggtgcctgctcgagatgcgcttatcggcgcactggtagctgcattactctttgagttgggtaagaaagggttcgcgatgtatatcacgctgtttccctcttatcagttgatttatggggtattagcggtcattcccattttattcctctgggtgtactggagttggtgcattgtgttattaggtgcggaaatcaccgtgacattgggtgaataccgcgccgagcgccatcacgcgaagagcgtcatcacccagagtccggagatgtaaggcattatgattgcgttgattcaacgggcgcttagcgccagtgtcgtggtcgaagggaatatcgtgggtgaaattggccctggcctactggtattactcggcgttgagcaaggagatacagagcaaaaagcacagcgtttatgtgagcgggtactggggtatcggatttttagcgatgagaatgacaaaatgaatctcaacgtccagcaagctgggggcagtgtgctggtggtttcgcaatttaccttggttgctgatactcaaaagggcatgagacccagtttttctcgtggtgcgatcccgcaagaagctgaccggctttatcagtattttgttgctcagtgccgtgagcgtggtgtaaaaacggaaacagggctttttgcagcagatatgaaagttagcttggtaaacgatggtccggtaactttctggttgcaagtctagagatgaacaccgctcaatacaggggggttctcctcctgctcgatatcgcatgttgtgagtgacacgtctgaatgacagaggtgagccagttcgtcggaattcgcttgtttccccgttggctacaatgctaataactttgggtatcacatggtttttattgataattttaaagagagaacgctcctatgtatcacttgcgtgtgcccataacagaacaagaactcaaagattattatcaattccgttgggaaatgttacgtaagccactgcatcaaccaattggctcagaaaaagatgcctacgatgcaatggcccatcatcaaatggttgtggatgagcagggtaaagcggtcgccattgggcgcttatatatcaatgccgataatgaagcggcaatccgtttcttggcggtggctccgtcagtacgcaacaaagggttagggacgctagtcgccatgacattagagtcagtggcgcgtcaggagggggtcaaacgtgtggtgtgtagcgcacgtgaggatgccgtagatttttttgccaaactgggttttgtttgtcagggagagataacggcaccgcaaacgacacctgtacgccatttcttaatgatcaaacccgtggcgacgatggatgatattttacatcggcccgattggtgtggtcagttgcagcaagcttggtacgaccatatccctctgagcgaaaaaatgggggtacgtatcagccagtataccggccagcgttttgttaccaccatgcccgaagcggggaatcaaaaccctcaccatacgttattcgccggtagccttttctcattggcaacgttgaccggatgggggttgatttggctattgctgcgagaacgccatttaggtggcacgattattctcgccgatgcacatattcgctacagtgctcccgtgacggggcggccaagagcggttgctgagttgagttctctgagtggggatctggatcggctggcgcgtggtcgccgggccagagtgcagctaaacgttaatttgttcggcgatgaaaatcagggggctgtttttgaaggaacttatatggtgctgcctgtcgctgcaggcgatgacatggctaattaatcctctggtacccttaaaatcactgacatgagccagtgatttgccgtcggatgatgacgaacccgagtattattagccagcccgctattgcaaggcaggacgttggatagcagaatttacctaattaaccgcccttattgctctgctgtgccctgcacgaccccatgtaataccgtttgattgatttgttgcccgttgctgtctattgcctgtagagagccgttaagggtgggtttcaatggtgcgtcggctgtcagattgccctttatctgcaatttcaagttacccagaccttgcaacggtaatgctggccatccccagttgtgtaaaaaattaaggtcaacagaacggcctgtcagagcgagtgataaggctctgtctggggtttgatcaatactggcagtggcttctagcaacccctctttagtaaacgcacttaaatcactgaacgtgatctgctgttcattggcattcagcgccagtgaagggcgtcggatatcgtttttattaaatgttgcattaccggcattcaacaccagtgacccggaccatacgccccattggtgatttttggccagtaataggttgctgcctgctgcatctaatgaggtgatttggaagggaaaatccgggctgatatcaatgagtaagttacggttagcactcaatttaccgacatacacctcagacagccagtctggcaatgtttgttgccacagctgtttccaatcgttcggcagagtgtaaaccagtgccacaacagtcaactcacccagttgtaaccgatgcgtagcacgggaccaactccccagcgttctcaacagaccatcttgccaacgggtagtgaattggttaatcgccacgccctcaggtgacaaggtaaacgtcgcgattgggtcaatcagatgaatattacctttaataatatcactggcattgaacaccagttcgccatcatcactttgccaatccccttgtttaaaggtgatgttttttagcgtcagatcaacatcattcacagcccagccttttccttcaactcgcgcatcaatcaaatcaaaccgtttgagggtgatagggggtaactgtaaaacattattccagacatcttctaagctggccgttgtttgcaagcggatattactcagacgtaggcgatcaaccagccaactgccatcagcagactgacgggcattgccggtcaattccccttgggcgatattggccccgaaattggtcagggtcaggatatctttctgtattgagccttgcagataaatctgttgggctgatatgtcattaatcgtcaggaagccagcactgaaatggaattgggtattttccccaaagctgttgcctggtattggttgccaaggcactagccccccgttgacatgctgacctgcaattttccactggctggtcgcgttttttgattcaaccgtggtattcagcgtcatgtcggttaactgtaaggtatcagcctgcaacgggagtgacggtgtgctgttattgagggttaagctaccattttgtaattgcagactgagaaaatgcttaggatcagtcagttgacgccaactcaggccaaaaatgacctgctgagcggttaggaacgggggctgatcggcacgtgctagtgtgacatcactaaaactgatttgccctggttgggaccatcgatgatcgatcccccttagagagaggtgataaccactgttattgctgacccaacgactaagccagcccgcggcccaactggtctgaagcactgcgtagcacagcacgatagacagcgcaaacagcagcaataacgttagcagcgttttcccgagaaatttcatctggccaatccacgtctgtcagtatgaggaacactgtttatgccgcaatttttccattagctcaatagataatcagctatcggaccataaaaaaatggccggcatcattaatgaccgaccatttcagtgatgtgttagcgtaaagactatttttcttgtgggaagagtaagttaagtacgatggcagtaataccgccagcggcaatcccagaagagaacagcgttttgatccagtcaggcgcaaattgcaaaatcaatggctgctgtgcgacacccataccaaccgctaatgataaggccattatcataatcgcccggcgattcagggtctcgcgtgacacaatacgcactccagacgctgcgatagtcccgaacatcacgagagttgctccacccagtaccggctcaggaatatgctgcacaaacccagcgacagcagggaacaggcccagaatgatgagcattattgccacaacaaaaccgacataacggctggcaacgccggtcaattggatcacgccattattctgaccgaagcaggagttggggaaggtattgaatatagcggacagcatcgagttcaaaccattggccagtacaccgccttttaggcgtttcatatataacgggccgcgaaccggttgctctgatacatcagatgttgcggtaatatcgcctatggtttccagtgaggtcaccataaagatcagcatcagaggaatcagtaagttccagtcgaaggacagcccatagtacaacggcgttggaatagtaatcagcgcggtatctacaactgggcggctctcaggcaacatccccaatgcccaggcgagcagataacccacggccatagcgataaccaaagaggcaacacgtaaatacgggttacgctggcggttaagcagaatgatcacccccaatacggcaccggctaataataagtttttcggtgcaccaaaggtgttatcgctcatcgcaccataaccaccaccaatagatgtcagcccaacttgaatcaatgacaggccgataatcatcaccacaataccggataccagcggggtgataatacggcgtgccagatgcagcacacgtgagagtaagatctcggtgcaggacgcaaccattaacgtaccgaacagcgccgccatcatcgttgggatatccgccccaccgttttttagcgccagcccccccataatcaacggagaaacaaagttaaaactggtgccttgaatggataacaggcctgaacccacggggccccaagttttaatctgcagtaaagacgctaggcccgaagcaaataacgacatactaataatgcgttgagtatcttctgcgggtaaccccaaagcctgacaaatcaataaaccgggggtgattaccgcaacaaacatcgccaagagatgctggcaagcggcaaacagtgtttgtgggagtggcggtcggtcttctaggtggtagatcaattcgctggggcgagccggtgatggctgtgcagtatcaagttcggcagattgcgtagacatggcgtggtatttccagatcggcaaagggggcattttaatgatccaactcacaaaagcaatcgtttgcgctgggtttttatattatttctatttttttgctaactcacattttttataactaaacttgtattcttcaccatttttttttctaatcctctcttctattactttggcgttttttaaggaactgtctaacgtcatatttttattagatattttattgcatggagtaccaagatgtttcatctcgatacctatggcacgctagttgcggcctgtctggttttactgttaggccgaaaacttgtacaaaccgtccctttcctaaagaaatacactatccctgaacccgtagccggtggtttgctggtggcttttatgatgcttctggtacagaagacgctgggctgggaagtcagttttgatatgtctctgaaagaccctctgatgctagccttctttgccacgataggtttgaacgccaacttggccagtttacgggctggaggtaaggctctgagcatatttgtctttatcgttgttggcttactgctggtgcaaaacacgattgggattgtgctggctaaattgatggggctggatcccttaatgggtctcttggctgggtccatcacattatcgggtgggcacggcactggtgctgcgtggagtaaattattctctgagcgttacggatttgaaaacgcaacagaagttgccatggcttgtgcaacctttggtttggtattgggtgggttgattggtggcccggtcgctcgttatctggtgaagcactcttccacgccagagggtaccccggatgatagcgccgtcccctctgcttttgagaagccctctgctggccgtatgatcacatcactggtgttgatagaaaccatcgccatgatctctatctgcctgatggccggtaatctgattgcaggttggttgcaagggacgatgttcgagttaccgatctttgtttgcgtactatttgtcggagtaatccttagcaatacgctgtcagccagcggcttctatagagtctttgaccgtgcggtatccgtgttggggaatgtcagtttatcattgttcctggccatggcgctgatgagcctgaagctgtgggagctggcttcattagcattaccgatgttggtgattttgtcggtacaggcgttggccatggcactgtacgcgatatttgtcacctaccgtatcatgggcaaaaactatgatgcagcggtattagcggcaggacactgtggcttcggtttgggggctacgccaaccgcgattgccaatatgcaagccatcaccgaccggtttggcccatctcatttggcgttcttggtggttccgatggttggcgcgttctttattgatatcgtcaatgcgattgtgatcaagctttatctgttgttgccaatatttccagccgtaacggggtgatagctccgtcatgctgcgggtagcatatacgttagttaccctcgctcacaccagttactttcttatgtgagtggctgggaattaagaagcctcatgaatgaggctgaggttattgacaaagtgcccacgacggagagaacaggcagatcgtaaagacgccgtaaatacatccatgtaggctcgagccgcgccctccctggcgcggacgctttactcttctgcctatcctcaccgttcaagagtgagtcatcggggtttgtcagcagtctgagcctcatgaatgaggctgaggttgatgagcacgaattttgaggatattagggctgacagagcgggttttttatcggccctgccatttgcaccctttacgcattggtataccgtacccgctccggcaaccagcgttctatcaatgccttggcatgttcagggtactgttgatgcagatgacgggcgacccgctgaacttctgggatcatcgcttgatcacgaagtaggtcggcaaccttaaactctgcgctacctgtttgccgtgtgcccaatagctcaccggggccacggatttctagatctcgctgtgcaatcacaaaaccatcattgctatcacgtaatacctgcaaccgcatttgagcggttttacttaatggcgttttatagagtaatacgcagtgggaagcgacagcaccgcgcccgacacgcccacgtaactgatgtaactgcgccagccccaaccgttcaggattatcgataatcatcaagctggcattgggcacatcaactcccacttcaatcaccgtggttgcgaccaataactgtagctcaccttgtttaaaggccagcataatcgcctgtttttcggggcctttcatccgcccatgaaccaagccaactttaatttccggtaaggcaattttcagctcttcgcacgttacctcagcagcctgagcctccagcaactctgattcttcaatcaaggtacatacccaatatgcttgcctaccctcttccaggcacgcatttttaacccgctgaataacatcactacggcgagtatccgggattgccaccgttgtcacgggggttctgcctggcggtaattcatcaatcacggaggtatcgagatctgcataggcagtcatggctaatgttcttgggatcggggttgccgtcatgattaattgatgtggatggaagccttgctcctcacctttttcccataacgtgaggcgctggtgaacaccgaaacgatgctgctcatcaataattaccagtgctaaccccgagaattgcacctgttcttgaaacatggcatgagtaccgatcaccatggagacctgaccgctggcaacggcctcttgttgtgctaaccgcgctttccccttttgcttgccagccaaccagccgacactaaacccaagaggctccagccattgacggaaagtagtggcgtgctgttctgccagcagttcggtcggtgccatcagggcaacctgcttaccgtgagcgatggcccgtagcgcggccagtgcggctaccagtgttttaccggaaccgacatccccctgaatcagtcgcatcatcgggaaactttgggtcatatcccgttcaatttcggcgacgacccgttgctgggcttgagtaggcgtaaaaggtagggcggccagaaaacgttgtttaagctgctcttcggccattaatggcaatgctcggtagctttgtgcacccgccctgactgccaacatactgaggttatgagccagcaactcttccatgatcagacgccgttgagcggggtgcttcccttgttctaaatcagctaattgaatatctgccggagggcgatgcagagtatgaatcgcttcaggcaggctgatgagagaacggctcaattcaattggcagtaactcagcaataacacaggtgtccagcattgccagtgcctgatcgataagtttgcgcagagttgcctgacgaatgccctcggtcgtgggatagactggtgtcagcgattcctgtaattcaacgccaatattctcgccatgaacccgatattcagggtgaatgatttctggcccgttattgcctcgtttggcttcgccataagcaatgacatgtttgcctactgacagactgtttttcattgctgcattgaagttaaaaaagcgcagggtgagaacgccgctaccatcgctgatttgacaggtcatcatacggcggcgaccaaagctaatatcagagcgtagaacttcaccttcaaccgtgaccgaaagaccgggcagcagatcaccaatacgatatagacgagtacgatcctcataacgtagcggaaggtgcagcagcaggtcctgaatggtttccaaacctatcttggcgagttttccagcctgacttgcgccaactccggaaagtgtactgaggggtacggcgtccagtaggcggcctttcatttaagactccgtggcttgcatggccgaccaccattgcgcatcggcaatgatttggccttgttcatcaatatgaggttgggggagccctttacgtttggcaacgtgtgccaataccgggtaacccccttcaaacaatagccgttgctgctcactctctgccagaacgctgtgtgtccgtttatacatcccggcattctgccgttgccgctgtgcttcatataaaattagcgcggaagcgacggaaacattcagcgactgtaccatgccgatcattggaatgatgatgtcttgatcggccagtgccagcgcttctggtgaaataccggttttttcctgacccattaaaatacaggtagggcgggtataatcgatttcacgaaaatcaacagccttatcagacagatgtgtcgccagaatttgcatatcttgtgattttagataagcaatggcatcagcaatatggggatgcgttttgacttgcacccagctattactgcctgcggcggcggacagccgagtatacatttgcgttgttggccagatggcatgaacttgatggatgcccacggcatcggcagttcgaataatggcggagacattatgaggtttgtggacttgctccagacagaccgttaaatcgggttgcctggtggcaagcatgtcacaaatccgcgcatagcgttgaggattcataggcgttaattgcgattacggctaactttaaccacatctggcatgatacggattttacgcataatgttagccagatggacccggttccgagtggtcaggcgaataaaggcgctgtatacccggccatctttttcttctgtattcaaactctgaatattggattcggcggcgttaatcgcggcggtcagattggcaagcgcaccttgttggttaaacatatcgactttaatttcggcaataaactcttgttcagtctcttggtcccattctacagccataaatttctcaggctctttctggtaaccacggatattccgacaagattcgtgatgaataaccaaccctttacctgggctgatatgggcgataatagggtcaccagggattggacggcagcacttggcaaacgtgataagtacgccatcggcacctttgatcggtaacttgcgggtaccagaagcagaggtgcccagtgttgatggatcgcccaataggtttttagccaccactacgctcatggcattacctaaaccaatttctgccagcaagtcatctaccgtagccagtttcattctatccaactcgtgtttgatattttcttcagaaatatcagagagtttacgcccatttcctaatgcatgattcagtaaccggcgaccaaggctgaccgattcatcacgtttaagatttttcagtaattgacgtattttggctcgcgcttttgaactgacgacaaaattcagccaggcagcatttggtctggctcctggagcggtaataatctcaaccgtctggccactactcagtggctgagagagcgggtacggctgacgatcaacgcgggcacctacgcaggcatggccgatatcggtatgcacaacataggcaaaatcgaccggtgtggcaccagccggtaattccacaatgcgcccttccggggtgaaaacgtagatctcatcagggaataaatcagatttcacgctttcaataaattcaaatgagctacccgcgctttgttgtaactccagcaagctttgcatccaccgctgagcacggatttgagccgtggtaccggactcaccttgttctttataagcccagtgtgcagcaacccccatttcggccatctggtccatatcttcagtacggatttgtacttctaccggtacgccatggggaccgattaatgacgtatgtaatgattggtagccgttagccttagggatagcgatatagtcttttacgcgcccagggcggggtttatacaggctatgagcctgccccaacacgcggtagcaagtatcgacttctttgacgataacccgaaaagcatagatatccatgatggaatggaagcgctgttctttcaggtgcatcttgcagtagatggaatacagatgcttctcacggccactgacccggcaaggaatgccagcctcggtcaagcgcccttcaatctccgcgaggatcttctgaatcatctctttgcggttaccgcgcgcggcttttaccacttctttaatgacgcggtaacgattgggatagagtgcttcaaaacccagctcttccagctcggtttttaaatgatgaatacccagccggtgggctagtgggctgtatatctcaagggtttcgcgagcaatgcgccgacgtttatccgggcgcaaagagcccagtgtgcgcatattgtgtgtacggtcagccagtttgatcaaaatgacgcggatgtcttgcaccattgccatgatcattttgcggaagttttccgcctgggcttctttcttgtcacggaagttcagtttatcgagtttagatacaccctcgactaactcggctacgcttttcccaaacagctgttccatatcttgatatgtagcaggtgtatcttcaatgacgtcatgtaatagcgccgccattaaggtttcgtagtcgagccgcatctccgcgagaatacaggccacagcaaccgggtgagtgatataaggctcaccgctggagcgtgtctgcccctcgtgagcatcacgtgcgacaagatatgcctgtttgaggcgcttaatctgctcctctggcaggtaacgttgaatcagcagattcaggctttcaaacaggtacaaaggcagactcgcagtctaattaacgacgaccttcagcaatggcggtaaccgcttggatctctgcggcttcctgctcttgctgctcttggcgctcacgaacatcgagaatctgattggtgatcaggccttcttcgatctcacgtaacgcgattacagtaactttatcgttctcttctggaaccagtgcgtctttaccgccggactggatttgacgtgcccgacgagcagcgaccaacaccaggtcaaaacggttaccaattttctctacagcgtcttgaacagttacgcgtgccataattctgctactccacaggtgacgaaatgactgggcatgatactgaaactctgttcagtccgccaataatttgctgattaaagcgtcatgccgctgtttctggcggcctaaacgcagtcgttctgcgcgaataatggttttcagatcagacaaagccagattgaaatcatcatttacgattaaataatcatactctgcgtaatgagccatctctgcgacagcttgctccatacgcttagcgataacttcttcgctatcctgcccacgaccgcgtaaacggcgatccaattctgttttggatggcggcaagatgaaaatactgcgagcggttggcatttttgcgcgaatctgttgcgctccttgccagtcaatatctaaaaagacatcaaccccggttgcaagaacctgctcaatagccagacgtgaggtaccgtagtaattttcaaatactttggcatgctcaaggaaagcatcatcatcaatcatctggcaaaactctttttcagaaacaaagaagtaatgctcgccgtgattctcccctggacgtttagcacgcgtggtatgggaaattgaaacctgcgtgtcgtacagcggttgtgtttttaacaaagcctgaatcaggcttgatttccctgccccgctgggcgcggaaactatgtatagcgtaccttgaaccatgatgacgtttcagttgattaggttgatatacccttcttaccttgaggttgcagcagtgttagcagctctttctcgaatgactggttctagccaactcaccggaactcgctcgttgcctacccgcaactccaattactttgggtgtatatagaaagcagaagtgtgaatctccgcacagtatacacgggtgtcacgcgtcatgcagcgttacaacacatttcacctgaatgttttgcttataaacagcctgattttcttattttgcgaggaatattgtgtcatttcggtttgttgcagcaatcacgaaagtatttttcagcactgtacgcattttactcttttaggcttcgacgggtagcttatttcgcgttttacttccgatcacaacggaaggaggcttatgaacatactgaatctaaagataataatgttcctattaatatctaacatcatagtggtgggcggtgcttgggctacatcaacatgccctgattggcctgcaaccagaatagcggttgagattaacgcgttggagcaacagttgaataagtggtcggccgcttaccatcagcaaggtcatagcccggtcacggatgacatttatgatcaattacaggacaaattacgtgtgtggcaatcctgtagggggttacctgataagacggaaagccagccgatccccggcaaagggcaatttcttcaccccgttgcccataccgggttaaaaaaactcaaagatgaaaccgccctcacgaggtggatggcggggcggaaaaatctctgggtacaacccaaggtcgacggtgtggcagtgacactggtttatcacggggggaaattggtgcaacttcttagccgaggaaatggagtaaaaggtcaaaactggacagaaaaagcgccatttatttctgctattccccaatatattgcaaatgcgcctgcactattaacgttgcaaggggagttgtttctactgatggatggccaccagcaagcaaaatcgggtggggtgaatgccagatcaacggtggcaggtgcactgatgcgcaaatctccgtctccgctattagctcaagttggggtctttatttgggcatggcctgatggcccaacaaccatgaaagagaaggtggcactattacaggtaatgggttttccttttacagctaaatacagcgagcccgtcatgtcgcatcttgatgttgtgcaatggcgtcagttctggtttcaagcaccactgccgtttgtcaccgatggtgttgtggtcaggcaagaggaggagccagccggtcgttattggcaggcaacaccggggcagtggtctatggcgtggaagtatccgcctttgcaacacattgccgaagtaaaagatattcattttacccttggacgaacgggtaaaggcacggtggtattagaggttttaccgataaaaattgatgataaatggattcgtcgagtgaatattggttcggtcacccgttggaaacaatgggacatcgctcctggtgatcacattacattggcacttgccgggcatggtatccctcggctagataacgttgtctggcgagtacaccaacggaatactattacggcacccaattgggataaattccatcagctcagttgctttcaacgcttaccacatggctgtgaacctcagtttttatcccgcttgatatggcttagtggcccaggggggctagatattggcggcatcggtggcggcttttggcaaaagcttattcaccatgagttaattaatgatttggtcggatggttattactaacaccagagcaaattgcaagtatccctggaattggaaatgcgcgggctgaaaaaatttatcaacagtttcaacgggcaaagcagcaacccttttctcgttggttgctggcattggggttcccgcaggttgtttccgttgacgcgcagtggcaggttgtattgcgccggagtctatctgaatgggccaccatggccgggattgggcaaatgagagcaaaacaaattaagcattttttggatcaccccgacgtacaagcactggctgatttcttatctactcagaaagttgttgggttcgagctcacagagtaaatcctcctagggctataacttaatggtctgagtgctcatatttgaatacaggcaggccaagccggaatcgtaaggcgagtaatctagcgctaagcccggtgatgagcgtaatgataatgacccaattatgggacagcggcgtgtattgcagagcaatgtaaatccaggctgccgcaaatgagatgcctgcataaatttctttctgaaacactaagggaatgcagttgcagagcatatcgcgtagtacgccaccaaagacaccagtaatcacggcggcaatagcggcaataatagtactgtggcccatatcgagagcaatttgtgcgccaataattgagaaaacaatcagcccaatggcatcaagcactaaaaatagatggcgtaactgtttcatcaatggagccatccaggtggtgacgatcgctgcgatggcgacgatcacaatgtattcaggatgcttaacccaaccaagtggatagtggcctaaaagcatatctctaaccgagccaccgccaattgcggtcgctgaggcaataataataacgccaaacatatccatttggcggcgacccgcagccagagccccggtcatggcttcagcggtgataccaataatataaagaacactgagtagcataatgaatcaaatgttggagacaatgaaaggccgcagagtaatcacaaagccatatcaacgcgactgagattttctaagtgatactatcagtgttagttaatctaatttaaaatcaggccattcatttgatttatttaaataaaaaaaccacattcttattgtcttacataagtaaatctatggggtggtaatcatattggggccttatagagatactattggctcttttcgcggttatcttgaactcagtattaaccatcattaatgttaatgaatgtggcagtagtatgggaaatatcacggcgctcatcacattgccttaatttaaggtgagggcgacagctacgtcataactccgtgatacacgaactgaagttctttggctgtgtctttggcttttgataaaaataattcggcatatgaatcaatcatcattgcgtaggcttttcctgcgaaccagcaagcccgcagattagcgagcttgctggttttttgtgttctggtgatagcttatgaaagattactcgatattctgaatctgttcgcgcatctgctcaatcaacacctttaactcgatggcggagttagtgacctcggcattgatggattttgatgccagcgtattcgactcgcggttgaattcttgcatcataaaatcaaggcggcggccaacggcttctttcttcttcagaatgttgtatgtttctttgacgtgcgcttccaaacgatctagctcttcggccacatcgatacgttgtgccattagcactaactcctgctccaaacgagtattttccaactgaacttgcgcttcttccagtttgttcagtaagcgctcacgttgccactgcaagatatttggcatatgtgcgcggactttaaccacttcagcgctgaccccctctaaacgctgctcgataagcgttttcagtgctgccccttcagtttctcgggaaacaataaaatcgtctagggcggtatctagcgcctgcattaactcggtgctaatcgcatccaaatcttgttcctcagcagacattacccctggccagcgcaggatatctactgggttaatttcgccttcatcactttgcatcttgacccaattaccggcttcaactaactgcttcgccagtttttcattgaggatcaaagagctttgtgcgttggcatccaactcaaaacgtaaatgacattcaatctttccccgtgtcagacggctgcgaatacgttcgcggatcaccggttccagactccggaattgttctggtaagcgaatgtacgtttctaaatagcgttggttaacggaacgcagctcccaggctgcgttgccccattcacccttaatatcacgtcgagcgtaggcggtcatgctgcggatcatcgttgcgtacccgttttaaagaaaagatggggggattatagcttcgcaggtgcgggcaggataggcattacatcactaaggccgtataatgcgcgaccaatatagatttcaagccggagaaagcccatgcgtccagcagaccgagcagctcaacaagttcgcccactgactttgacccgtaattacacgaaacacgctgaaggttcagtgttggttgaattcggcgataccaaagtattgtgtaccgccacagttgaagaaggtgttccacgctttctgaaaggccagggccaagggtggataacggcagaatatggcatgttgcctcgttcgacccatagccgtaatgcgcgcgaagccgcaaaaggtaaacaaggtgggcgtactcttgaaatccaacgtctgatcgcccgttctttacgtgcagcggtcgatttgaaaaagttgggtgaatttaccatcaccttagactgcgatgtattgcaagcggatggtggcacccgtaccgcctcaatcagtggtgcttgtgtagcattggctgacgcgctgaacaaactggttgctagtggtaaattgaaagctaacccgatgaagggcctggttgctgctgtgtctgtcgggatcgttaaaggcgaggctctttgcgatctggaatacgtagaagattctgcggcagaaacagatatgaatgtggtgatgatggaagatggccggatgattgaggtgcaaggcaccgctgaaggtgagccgttcagtcacgaagaattattggcgttgctggatctggcccgcggagggatagaaaccatcttccaggcgcagaaggcggcattggaatcataaatttattaggcgacggatagtcgcctttttttacccgctaacttggaatgccaagtgttcgcgcatttacctcagttataagtcacgttagccatcgggtaatgaaccaaattaacacataacgttattaaccaaagcagtcacaatctggagaggagacgtaccaatgaaagcctatcagcgcgagtttatcgagtttgcgcttaacaagcaggtgttgaaatttggtgaatttaccctgaagtctgggcgcattagcccttatttcttcaatgccgggttgtttaacaccgggctggatctggcgaaactgggccgcttttatgctgctgcattaatggattgtggcgttgagttcgatctcctgtttgggcccgcctacaaaggtatccctattgcgacaacaaccgccgtggcattggcagagcatcatgagcgcgacgtgccttactgttttaaccgtaaagaagcgaaaactcacggtgaaggtggcaatcttgtcggtagcccattacaagggcgggtgatgctagtggatgatgtgataaccgccggtaccgctattcgtgaatcaatggagattatcaatgcgcagggcgcgaccctcgcaggtgtgatgatttcactggatcgccaggagcgtgggcgtggtgagatttcggcgattcaggaagttgaacgtgattatcactgtaaggtcattgctatcgtgacgctgaatgatgtgattcgctatctggaagataagccagagatggctgagcatttggtggcagtgcggcagtatcgcgagcaatatggggttaccctttagctgtaacgctaataacatggggtaatcccgaatcaagctacgccaagagggccgtttgccctttttgcgtagcttgattcgctgttctctctatgtcttacggagaagaggaaagagaaagttgatcctgggttttattgcaactgggcgacaatcaatggccagcgggaatcaaactcttgtgttgggcagtaacggaattcagaacgaacgaagcgtgaaagcatcccttcgcaaaatgccaacaactgggtggccagtaacgcttcatcatggataaagccttgtccatcacgcagctttttctcacgaaggacttggcgtaactgcatttcaattcgttcaaatagctggttaatccgcccttgtaagcgatcctgctcaaacatgagcgcatgcccggtcatgattcgggtcagcccagggttgcgttctgcaaaccctaataccaacagcaggattaagcggaggcgattaaacgtctctttttcatcttgtagaatcaaattaatgcgggacatcagactatcttcaataaactcgatcaggctatcaaacatccgcgttttactggggaaatgccgataaagcgctgcttcagaaacccccacattagcggcgagtttcgcggtagtaatgcgttggctgccgtcgctggattccagcatctgcgctaaagcctgcaatatttcctcgcgcctgttccttttcgtattttctttttctgccatgtccgagtagacccttgctaaaaatgacttaataacaaaaacccaaacaccggccgctctgggaacaatgcccaggcggcttatgtgatagcttttttacggtattggggtctagggttggttattggcgtccagaatggccaaaaccaccggtaccacgttcactgtcggtaaagtcttcaaccagattgaactctgcttgtaccacaggaacaaataccatctgagcgatacgctcaccaggttcgatggtgaaaggctgctggccacggttccatacggataccatcaactgcccctgatagtcggagtctataaggcccactaaattacctaatacgatcccgtgtttatgccccagacctgaacgcggcaaaataaccgcggcgagggcactgtcaccaatgtgaatggctaaaccggttggtaacaaggttgtttgtccaggctgtagttctactgcgtgatctaaacaagcacgtaaatccagcccggcagaaccttcggtggcatacgtgggtaatggaaattcgttgccaacacgtgggtccagaattttaatgtcgatttttttcatcataacggctgacaatctcgtctattaaacgttgactgagaagatatttatcactgagtggtaaacgtttctctccagtcgaccaaaaaaggtgcaaggcattggtatcactgttaaaaccatgctctgcgagtgatacatcattagcgcaaatcagatctaaattttttcgcgccaacttttgtcgcgcgtattcttccacattctgggtttcagccgcaaatccaacaacaaatggacgatttttagccattgaagccacaccagcaacaatatcgggatttttcaccaacttaagtgtgatttcgtcaccttgtttttttattttctcgtcagaaacgtgttccgcgcggtaatccgctactgcggcacaagaaataaaaatgttctgctgctgtgctattttttgaacagcctgctgcatctcaagagctgtaatcacatcaatacgttttacaccttcaggtgtcgataaattcacggggccagcgattagcgtgacgttagatcctcttgcagccaatgcttgggcaatcgcgaagcccatcttgcccgaactttgattgctgataaagcgtacaggatcaagtggttcgcgtgttggcccggcggtaatcatgacactcaaatgttgcagatcttgctttgcagagaaatgattgtacgctaaagccacgatttcttgtgggtctaacattctaccagggccgatatcgccacaagcctggctaccgctatctggcccccacagcaagacaccccatttagacaaggtttgtaaattctcctgtgtggctggcgcacggtacatttgctgattcatggccggtactgcggcaataggcgcagcggttgccaaacaaacggtggtcagtaggtcattggccattccggctgccattctggccagtaaatccgccgtagcgggggcaataatgactaagtcagcccatttgcccagttcaatatgccccatagcggcttctgccgcaggatcgagcaaatcatcagaaacgggatagcccgagactgcctgtagcgtgagtggtgctatgaacgctttagcggcgtgggtcatcactacacgcacatctgcacctttgtcgcgcaaacggcgtacgagctcaggagatttatatgcggcaatgcctccgcttatcccgagcacaatatgcttgccggaaagtcccgtcatcatgattgtccgaatgaaagctgtaagaggcgatattttagcataaccattgaacagattagctatcagggcactctctgaagcgaccaatcgtaaaatttgcgagacgtcacgcatgctatcaagcgtgaggtcgtggtgcgttaagccctatgtcatgctattcacgtagttcaggaataacaggagctaaggaatggatgagtggtatgggcaggtggccccaagagagaaattactgaagtatggtgctgcggtactgactgatgctgaactactcgctatttttttgcgtacgggtattcctgggatgcatgtgatgaagatggctgagtatttaattgagacatttggctcactgcatgggttgatatctgcagattatcaaacgttatgtgcccataaagggattggtgcatccaaatatagtcagattcaggctatcggtgagctggcctgtcgttgtttttcatctcatctgatgcgggaaagtgttctgcttaaccccggtatcacacaaaaatttctgcaaaatatactgtctcaccgtgaacgagagatttttttagtcgtatttttggataaccagcatcgtgttattcgccatgaagagatgtttactggtaccatcagcagcgtagaggtccatccgagagaaattgtgcgtgaagcgctgaaggttaatgccgccgcgctgattttggcgcataatcatccctctggtaaggctgaaccgagccaagctgaccgtttgataacgacgcaggtgataaaagcctgttcattattagatattcgggtgctcgatcatttagtagttggccggggtgaatgtgtctcatttgctgaacgaggatggctttagagcaatatttattgatcctttcgggatctttagctgttcgggacttgagcacttacgcttcagagcgtatactacgccacctttgagaatcttgggtttggcgtgaagagcctatctcagcaggtttttgcctggtgacaggggtttctgacctgatgacagtgagtcttctcagtgaatttgctgagatgggctctaaagcctgacgaggcggccataccctatacgaagctcgagctgatttgatttttggagaatagacatgtcccgagtctgccaagttactggcaagcgcccgatgagcggtaacaaccgttctcacgcaatgaacgcgaccaaacgccgttttctgccgaacctgcactctcaccgtttttgggttgagggcgagaagcgctttgtaactctgcgtgtatctgctaaaggtatgcgtgttattgataaaaagggtattgaaacggtcttggccgaaattcgtgcccgcggtgagaagtattaaggaactgaatcatggctaaaggtgttcgcgagaagattaagctggtttcttctgctggtactggtcacttctataccactacgaagaacaagcgtactaagccggaaaaattggaattgaagaaatttgatccagttgtccgtcaacacgtactctataaagaagctaaaattaagtaattttagcggactaagaaaaacccggccttggccgggttttttattatataaagtacagtgagatacgttgaaaggaggttaaatgcctgaattaccagaagttgaaaccagccgccgcgggatcgaaccttatcttgtcggccagacaatcctttatgctgtggtcagaaatgcccgtttacgctggccggtatccgatgaaattctaacacttagcgatcaacccgtactgagtgtccaacgccgggcgaagtatttactgctagagctgcctaaaggctggatcatcatacatttaggtatgtcaggtagcctgcgcgtattatctgaagagactgcagctgaaaagcacgatcatgtcgatttggtggtcagtaacggaaaaatattgcgttataccgacccacgacgttttggtgcctggttgtgggcgaaagaccttgagaccagtaatgtattagcccatttagggccagaaccactaagtgatgaatttactgcgcaatatctgttcgataaatcacgtaataaacgcacattgattaaaccgtggttgatggataacaaagtggtcgtcggagtgggtaacatttatgcgagcgaatcactgtttgctgctgggattttgccagatcgtgccgcaggctcattgactgacgctgaatccgtattgctggtagcaacgataaaagccgtgttattgcattcgattgagcagggcggcaccacattacgtgattttctgcagtcggatggtaaaccagggtatttcgcgcaagagttgcaggtctatgggcgtgcgggtgaaccatgtcggcagtgtgggcatcccattgaaatagcgaaacacgggcagcgcagcacgttcttttgccgccactgccagcattgagaggtttaggccaatttggccaataatgctttggtaaccggtttgggcaggaatggcgtgatatccccaccgtggcgcgccacttctttcactaatgaggaagagataaacgaccatttctctgatggcatcagaaatacgctttccaatttgggcattaagtggcggttcatattggccagttgccactcatattcaaaatctgatactgaacgcaaaccccgtaccaaaatattcgcattgtgctttttggcaaactcagccatcagttcactgaatcccagaacctcaacattctttagcagcgcagtcacctttttagcgagtgcgacacgctcatccaacgtaaacattggctttttgctggaactgtccgcaatagccaagatcacatgactgaacatcgcggatgcgcgcgtcactaaatccaaatgcccattagtaatgggatcaaatgtccccggatagatggctttggtgatcatgatttctcgcttttctgatactggtggctcaatgcccacagagcggcatatttattaaaagtatattgcgcgttgactaccgccagtaatagcccttgcttaccatcaaggaagccagcacgtaataaccacgttttactgaatgccccaagagtatggctgagaatggcaaaataactgcaacttttgccttgctgatgacgttggatggcccatgcttcggcataactaagctgtttacgttgaaaggcaaaaaagtcgcggcaagtcagatgcaataaatcaccagccagtgggataacttttgctgagccgctatcgagtgattcatggactaaattatcgttgtagcgatattggtgatgaggatataaccgagtcaccctatctggataccagccgctgtggcgcataaaacgccctaaaaagaggttccggcgtgaacagctataaaccgcaccctcttctggtgctagcagaacagattcaatcgcgattttaagctctggggtcacccgctcatcagcatctaacatcaaaatatagtcgccgctggcatattgttgagcgagttgccgctgtttaccgtaaccgggccaattgatgttgctgtaaacttttgccccgaattgctgagctaatgcccgtgtttcatcttcactgcctgagtctaatacgattatttcatcagcccaggccacggatgctaaacagtccgtcagcagagaggcttcattcttggttatcatcaccaccgacagacgttttttggtacccatttagtggctccgttgtggcagataaggctccaacaaatgtaataaccgttgtaatgcgccctgattttcatgtaagacatcaaccgcgtggcggccatagtagaggcggcaatcttcatcagtcagtaacaccgtgatttcttttaccagcgatagagtatcagtcacggtaattaacccttcagcctgctccagcttggcgcaaatatctttaaagttaaaggtatgtgggcccatcaacacgggaatagcatgagccgctgcttccagtgggttatgaccgccacgttcaaccaaactaccgccaacaaaggccaggtcggcaataccgtacagcagcatcagctcacccatcgtgtcgccgataacgacttgggtgctactcgagggcacttcacctttactacgtaatgtataactcaagcctatcttttgtgttaattcaacggcctttccgaagcgttcaggatggcgaggtaccaggatcagtagcaatgttgggaactgttgtaatagctgccgatgggcttccaacaagatagtttcttcaccgtcatgtgtgctagtcgcaatccaaacggggcggtgcggtgcccattggcggcgtaatgtcaccgctctggctgccaactccggtgtgacagaaatatcaaacttcagactacccgtcacggtgagctgggaacgtttaagccccagttcgatgaagcggtcaccatcctcttggttctgtgccgcaatcaacgtgatccgttgcagtatagtgcggataaaactaccgatcttcttgtaacctgccgcagagcgggcagaaagacgtgcattggcaataaccagtgggatcttacggcgatgcagagtgttgatcaggttaggccaaagttcagtttccatgatgataaccagtttgggattgacctggtcaaggaaacggttcacagagccggggagatcataaggtaaataaacgtggtgaacatctttaccaaaagcagactggacgcgctctgagccggtaggcgtcatcgtggtcaccgtgataggcagcgacgggtaacggtggcgtaatgctctgaccaatgggattgcagccagtgtttccccgactgaaacggaatgcagcatgataccgccagcaacgactttaccggcacaaaaaccatagcgttccccccaacgcttgcgataagcaggggctttacggctacgtaatagtaaacgcagccaaatcagaggttgaataaggtagagtaatacctggtataaacgcagcagcattctatcaatttcatttatatggattattaagaataataccatatctgggcaaaaaaggctctttccggctaggagggcggagcaccacattgagccgtggttattcataggaagaatataatatcttgctctgagtgataaaagagaggctatttattgattttttattacaaaatgagaatcattttcattgtctattgcactagataaaaactggcctggtatgggattaaaagagttaattatgctgtgttaaatggataagtaaattttctctgaaatcttatcgttagagctgttgggtgctatttatttgaataatatttctcaatttcatcgaccctgataattaccagaatcgatgaaagttttatatcggatgtttatgaactcactctttcagagacaataaagcagcgctatgaaatgagtgtttctaatcgtgccataatagtgggcgcagagaggctatccatctttttttgctcggaaatcacggcaatttggtttttcccgtagccgccgattaaaccggggtcagtggggccaaacagcgtaatgtttgggcgatccaaggcggcggtcagatggctgaggccagtatcgacagagactacggcttttgcacccgccagaacctcggcgacctgctgaagactgagcttaggcagaacctctacgtgtgggaaatgttccgctaatcgtaaagcgcgctgatgctcatgttctgcgccccacggtagtttgatttttaaacctgtgggttgcactaactcaatcaattgtacccaatggctctcgggccagtgcttgttgtcacgggtcgtcgcatgtaggaaaaccaagtactgacctgcatcggccggtaactgatttaaaaagcgttgtgcgatggcatagtcgccataactttccggtttatcatagccgaggcttttagcaaacagttgacgtatacgttctacggcatgttgtttggtatcaatttcatggcggcagttataaaaccaactggcaaacggctcacgggcacttttacaatccggcccgtgcttcgtgcctttcgcaatccgggttatcagcgcggcgcttttaatcaacccttgggcatcaatgacccgatcataactgcgttgttgtaccacacgcttaaaatcacagcgttcctgccgggtatcactaccaaaccagtttttacgccaacggcggatggccaccgggatcactttatccaccgccggatgccaactggggatttggctgaacccttcttctaccacccaatcgaagcgaataccgggtatggcattcatggcatccgtcagcgcgggtaaggtatgtaaaacatcgcccattgacgaggttttaacgattaatacgtgcattaatcgccccctttgactgagcattcttgcgtagccaattgcttctcaagcgcggccatcacgtgttcgggttggatatcaatcaaactttgatgatagccctgtgcagaatcgcccttgcggactttgtgatagccggtaatcagacggatcaccgtggctttctctgacagtggtggcgtgaagtctgggctgctcgggccatacaatgccactaatggcttgttgagtgccgccgcgacatgcattaaaccagagtcgttactcacgacggcactacaggcggcgatgagaacgaccgcttgttccagtgaggtctgccctgccagattgaggcaatattcacgatctgtatcgctgagagcctgacggatatcttcaccagcttcattgtctttcgcagaaccgaataagacgacctgatagccatcatcaatcaatttctgcgccagcgtggcgtagtggtaatgcggccaacgtttcgctggcccaaattctgcgccagggcagaatccaataatgggccggttatcggtcagattgaatgaggccgttgtctctgcaatttcttcatcgcgtacttgcaattgcggccacaacaacggttgtggtaaatctgccgctgaacggatgcgttctttatcataggccagcgcaacgtagcgctggaccatcattggaaaggcttgcttatccagaatacggaggtcattgagcaggaaataacgcatttcgccacgccagccaatacgtcgtttgatccctgaaaagtaaggtatcagcgcggatttaaatgagttgggcaacacgtaagcacgatcatactcggtttcacgtaaggccaatcccaaacggcgacgctcctcaaaagcaaatgccccatggcctaacggcattggaattgcgtgacggacttccggcattctggccagaagcggacggcaccatgcgggtgccatcacatcaatgtctgctgccggatattcggccttcagggtacggtaaagactttgcgacatcatcatatcgccaacccatgaagggccgatgaccagtattttcataccgtttatcaattccttgcagcaagtgatttagactgagcgattgagccaggccagatattctttaacgccttcagcgaccgttttaaacggtttaccataaccggcagcccgtaatttagtgagatcggcttgtgtatatgcctgatagcggcctttcagtttttcagggaactcgatgtattcgactggcccactttggtgataatccaccactgcatcagcgacagcctggaaagactctgcccggccagtaccgcagttgaaaataccggatacgccgttttgccagaaccacagattaacgtcagcaacatcacccacataaatgaaatcacgtttaaagttttcgctacccgcgaataacttaggcctttcacctgcattaatttggttattcagatggaaagcgacgctggccatgctgcccttatggccttcacgtggaccataaacgttgaaataacggaatccacaaatttgcgaatcggcttgtggcagaatttcacgcacatactgatcaaacaagaatttggaatagccataaacgttaagtggctgttcgtactgacgatcttcaataaagttgtcagtgcgcccaccgtaagtggcggcagaagaggcgtataagaaaggaatactacgatccagacagaagtgaaggatatctttagaatactgatagttgttatccatcatgtacttgccatcccactcggtggtggaagaacacgcgccttcgtggaaaatagcatcgatatcgcccatgtcatcacccgcaacaatactggcgacaaaatcttctttatccatgtaatcagcgatatccagatcaaccagattgacgaatttagtgccgtctttgaggttatcaaccaccagaatatctttgtagccaatattattcagagccttaactatattgctgccaatgaaacctgcgccgcctgtaacgataatcatcgtattcacccttgctaattttcttggttgggtaccacaccccaccccctatttggcactatcataacatttcataggatagcgcacagcgggaaggggggtaatctcttggtttctcggtcgctttaggatagttcgccgtgatatatgctacattttcgacaatataagataaggtttctcgtcagtttgcccaccaagcagtaaaatattgtgtgcaattgccaatcctggagataaccgaaatgtccctaccttgtaacaagcaccccttttatcagcaattagaacaacaactcgacacgactcgtaccgaagggttgtataaaaacgaacgcgttattacttccgcacagcaagcgaatatcgctgttgctgatggcagccgggtgattaacttttgcgccaataactatctagggctggcaaatcatccaaaacttattgcagccgctaaagccggcatggattcccatgggtttggcatggcttcagtccgctttatctgtggtacccaagacatacataaagagctcgaacataagctcgccagtttcctcgggatggaagacgctatcctgtactcctcttgctttgatgctaacggcggcctatttgaaacccttttagggcctgaagatgccattatttccgatgcgttgaatcatgcctcaatcattgatggcgtacggttatgtaaagccaagcgttatcgttatgccaacaatgatatgacagagctggaagcgcagctaaaacaagcgaaagcggagggggctcgccatatcatgattgccaccgatggcgtgttctccatggatggtgtgattgctaacttaaaaagggtgtgtgaccttgctgatgaatatcaggcgctggttatggtcgatgattcacatgcggtgggggtgattggtgcgaatgggcgggggactcatgaatactgcgaagtgatggatcgcgttgatatcatcactggtaccttgggcaaagcactcggcggtgcatctggcggttatactgccgggcgcaaagagttggtcgagtggctgcgccagcgttcacggccttatctattttcaaactcactggctccagcgattgtcgccgcgtctattgaagtcttgtcactgctggaagagggaggggcattgcgtgatcgtctatgggcgaatgcgcgtttattccgtgagaaaatgagcgcggctggtttcactttggcgggtgctgatcatgccattattcctgtcatgttgggtgaggctaaactggcgcaggattttgccaatgccttgctgaaagaaggcatttatgtcactggcttcttcttccctgtcgtgccgaagggccaggcccgtattcgtacccagatgtctgcaggccataccactgagcaagttgaacgtgccatcgaggcatttgtgcgtattggtaagcaacttaacgttattgcgtaagggattttcatgaaagcactttctaaactgaaagcagaagaaggcatttggatgaccgatgtgccacagccagagctgggtcacaacgatatcatgatcaaaattcgcaaaacggctatctgtggtactgacgtacatatttataattgggatgaatggtcacaaaaaaccatccccgtacccatggtcgttggccatgaatatgtcggtgaagtggtggccattgggcaggaagttaaagggtttaatattggtgaccgggtgtctggtgaaggccatattacctgtggtcactgccgtaactgccgtggtggtcgtacccacctttgtcgtaatacggtgggtgttggcgtgaatcgccctggttcgtttgccgaatatttggtgatccctgcttttaacgcgttcaagatcccagacaatatttctgatgagcttgcggctatttttgaccccttcggcaatgcagttcataccgcgttatcttttgatttagtcggcgaggatgtgttggtctccggggctggcccaattggtattatggccgccgcagtctgtaagcatgtgggtgctcgtcatgttgtcatcactgatgtgaatgaatatcgccttgatctggcccgtaaaatgggcgtgacccgtgccgttaacgtcagcaaagagaacctaaatgacgttatgacggaattgggcatgaccgaagggtttgatgtgggcttggagatgtcaggtgctcccccggctttccgttcattacttaattcaatgaatcatggtggtcgtatagcgatgctgggaataccgccatctgatatgtcgatcgactggaatcaggttatctttaaggggctgtttataaaggggatttatggccgtgagatgttcgaaacctggtacaaaatggccgcgttgattcaatctggtttggacttaactccgatcattacccaccgtttccctattgatgaattccagcaagggtttgacgccatgcgttcgggtaaatcaggcaaagtggtattaagctgggattagtttatccccttcgggcttggtgttgcaaaactacccgctgcgataccaagcccttgtcaggatttacgttttttgcggtggccgccttaccgcaatttgatattaatatcagcgattaaaataaagcgagttcccgattattgtgccgccttcttgggtggcaatttctctgtattttcaatcgctttctgttcatcaataggtgttgccggcggcgctggcgtaaaatattgttgccaatgttgctgaataaatatgaccgccgggttttgcatcaagctctcacccaataagataaacagcttatcagcgtagattttctcaggcacatagctggctttcgctttacattgcttgatagcgggcagacgttggcctttcaccggttcacgtggttttgttttgtccggagagagactttgtaccggttcatttagcagcgcactgggtctgactaagacgatgtcggcaggcaactgaggcaacatttgttgcaatactttaatggtcgcagggtgagggtgcccgatagcaatcgctgagccattgcggcgtgccagtgctactgcccggttaaattgttgacggatagctgcttcattttgtgagtcatctaaaaagattttccgcttgatcactttgacaccagtgccttcggcggctttgctcgcctggctattaccaatagtcacactgtcgagaaaatagagctggtagctccccagtgcctgcatcactttctgcatacctggcaaactggcggtcatcgcactgcccatatggttattcatgcctttcgcataagggacgttattcgcggcctggcggatgatgcgctggatttcctcgctgctcattgaaggctgcaaggtatcacgctccagtggctgtttactctgtggggccatcggcaagtgaatcaggatttcacgcccctgattatgggctttggttgccatctctctggcgtaaggagcattaggcagaatggccactgaaatgggcaggggcatctgtaaaatcttattttcgttttgggggcgataaccaaaatcgtcaataacaatagagagtttgccggcctgtgctgtgctggcgatgaatagcgtgcttacgatgataaattggcgtgtgttgaagtagcgcaatacgagttccctaacgttgttccctatcttcctaaccagggctgtgggttaacggcttgtccctgacggcggatttcgaaatagagcgatggctcgccctgcccaccgctggtacccacaagtgcgataggctggcccgctttaacctgagcgccaacattgaccaaggcactttggttgtagccatacaaactcatatcccctttcccatgctcgataacgaccaccaagccataaccttgtaaccagtcagccagtaaaacacggccatcggcgatggctttgacttcgctgccttcaggtgcggtgataaccatccctttccagcgtagttcaccttgtaggggttcaccgaaacggtgggacacgttaccacgaacgggccatagggcttgaccgccaggacggcccaagccgccggtgcgcgccatcaatgagcgctcactttcacttggtttataactgctaccggtcttcttcgcttgctgctctttgacttttacctgttcacgcacacgggccgcttctttggcctcccgttcagcccgagctttggcttcccgttctgctttggcgatttggtcacgtaaacggctttcgttcaactttaactccgccaaactctgctgatctttctccagcgaggcttccagcgatgtcagggttttttggcgggcaatacgcgcttgttccagcttctgttgttgcgctttctgttcatccagcaatgccttgtgttgattctgtttttgctccagcatttttttctctgcagacagcgtggtacgtgtctgcttcaactcttcaatggctttttgccgagcttcattcaggtaactgaaataagccaaaatacgctcactgcgctggctctcttcgccacttaaaataagttgtaagctactgtgtttgccttgtttaaacgccgctgcaagttgtttagacagaatactttgctgttgcgactgctgattttgcagtttttcaatcgaggtcgtgaggctggcaatatctttactcagttcagccagggtcgcttgggtctcgcgcaggctgcggctggtctgagaaattgtattttcttgctgttttagttgatccagcaatgaactgcgttgttttttttgttgctgaacacttttttctttttcagcgatatcctgttggagggttttgagttggtttttattctctgatgctttggccgcgacagggggttcgacagcctgaccagaaaatggcaataacagtacgccagcacaaaaaacgctggcatagagtgttgaccacggtagacgactcaacttatctgacagcagagagggagactctctaccgtcagagacggcatctttcgtagttattgatttcgccaataactctctatccttcataacgaaggattattccacgatgaacagcggcttaccagtcatctcttgtgggatttccatttccatcagtgacaacatggttggtgcgatatcagaaagcttgccaccttcaacagctttaacggctttgttacctacgtaaatcaggggcactggcaggctggtatgggcggtgtgtgcctggccagttgccgggtcacgcatttgctcagcgttgccgtggtcagcggtgatcaacaattgaccatcggctgctttcactgctgcaaccacttgttcgatgcagttatccagtgtttcaaccgctttcactgccgcatcgtaatcaccggtatgaccgaccatgtcgccgttcggatagttacaaatgatcacatcatatttgccgctaccgatggcgctgaccagtttttccgtcagttctgctgaactcatctcgggttgcaggtcataggtggccactttaggcgagttgatcagaatgcggtcttcacctttaaatggctcttcaacgccgccgttatagaagaaggtgacgtgagcatatttctcagtttcggaaatgcgtaactgggttttatcatgcttcatcaaccattcaccgaaagtgtttgtcagtgaggcgggtggataagcacaggcgactttaatatccgcggcatattcggttagcatgatgaaatcgccgaagttaaccactttatctcgcttgaaaccgtcaaagtcggcattaacaaaggtgcgggtaatttggcgggcgcggtcagcacggaaattcataaagattaatgtatcaccctcgttcatggccgcatcggcttcgccagttgcttgaatcacggttggtttaacaaactcatcattttcaccacgggcataggccgcttgcaggcccgcaactgcgttatctgcagtaaattcgcctttcgcttgagtcagtaaatcgtatgccagttgcacgcgatcccaacgattatcacggtccatggcatagtaacggccaataatcgacgcgatacggccattacccagttcagcaaacttggctgtgaatcgtttcagtgatgactcggcactgcgtggtggggtatcacgtccatcgaggaaggcatgcagataaatagcggttgcaccgcgtttagccgccagctcaaccatcgccataatatggtcttcatggctgtgtacaccaccggcagataacaaccccatgatatgaacggccttacccgttttaaccgcgttatcaacggcagccgtcagggttggattcgtgaagaagtcaccctctttgatctctttgtcgaggcgggtcagatcctgataaacaatgcgcccagcacccagattgacgtgaccgacttcagagttacccatttgcccatcaggcaggcctacatccagacccgacgcggcgatcaatgtgtgaggctgttgctgccataacacgtccattaccggggttttggcattcaaaatagcattatcctgctgttcttcacggtgaccgtaaccatcaagaatcgtcaggaccagtggttttttcgtgctcgacattgcataacctcttttcttataagtccaagtgttaaatagcagcgaacatcaccctgtaaaggagggagaatgatatgcgcggctatgtacactcggtatcccctttgtacttgatgtgacaacattgtacttgacgtgacaacattgcagggacatcaatgactttagggatatgtaccgaggcggtaatttactacagaacgggttaaaaatagcccagggagatcaacattggagtggggttttgcgcaattgacatcatttaatcaataaaacttcccgagattgttcgcagtttctacaatagcgcttgcttattggctgtatttgccgcaacgcgcaggtatactctgtgaccttgaatattatcccctaactaacgggagtttttacccccatgttgcaagaaattatgcaattcattagccagcatccaattttgagtctggcttgggtgttgttgttcggtgctgtggttttcaccagcttcaaaaattctctttctaaagttaaagaggtcacccgtggtgaagcgacgcgtctaattaataaagaagatgcggttgtggttgatatccgcacacgtgaagattatcgcaagggccatatcgccaactcaattaacctgatcccgagtgacattaaaaatggtaatttgggtgagttggaaaagcataaaacacagcctattattgtggtctgtgcaatgggcacaacgtcccgtgcctcggcagatatgctgagcaaagcgggttttgagcgggtattcaccctgaaagagggtatttccggctggagtggtgagaacttaccactggcgcgcggtaaataagcataaaagcttgtgcggctattatatcgatattccgtatatcggtatttagttgtataagtgtttgttataaaaactcgctatatcaatagattgtaaatttaactgaggtgtatccatggcgaagattgagatgtataccaaagcaacatgcccgttctgtcaccgtgctaaagcactgctgaacgccaagggtgctgctttccatgaaatcgcaatagataatgatccggccaaacgcgaagagatgattgctcgtagtgggcggacgacggtgcctcagatatttattgatgggcagcatatcggtggctgtgatgatttacacgccctggatgcgcgcggtgggctagacccactgctttaactcgtcagtgggccccgatattaatgggaaaagcccacgacggaagagctgtttaataaggacgtctaactaagggtatctatacacatgtcagaacaaaacaacaccgagatggctttccagatccaacgtatctacaccaaagatatctccttcgaagcccctaatgctccgcaggtttttcagcaggattggcagccagaagttaaacttgatctagatacggcttctagccaactggcggaagatgtgtatgaagtggtactgcgtgtgactgtaacggcctctttgggtgaagaaaccgcgttcctgtgtgaagttcaacaaggtggcatcttctccgttgcgggtatcgaaggcactcaactggcgcattgtttaggcgcatattgtccgaatattctgttcccgtatgcgcgcgaatgtatcaccagcctggtctctcgcggtactttcccacagctgaatttggcacctgttaactttgatgctctgttcatgaattatctgcaacagcaggctgaaggtgaagttgaaggtgttgaacaacgtcaggatgcctgatgaacaccaaccctgcttcaatggctgttatcggtgccggatcttacggcaccgcattagctatcacactggcgcgtaatggccatcaagtcgtgttatggggccatgaccctaaacatattcaacagctgcaacaagaccgctgtaaccgcgctttcctacctgatgctgctttccccgatacgttgcgattggaaaccgacttagcatgtgcgttggctgccagccgcgatgtgttggtcgtcgtgcccagccatgtctttggtgctgttttacatcagttgaagcctcatctacgtaaagatgcacgtatcgtctgggcaaccaaagggctagaagctgaaaccggccgtctgctacaggatgtggcccgcgaagtcttgggcgaggctatcccgcttgccgtgatttctggtccaacgtttgccaaagaattggccgcgggtttgcctacggcgattgcgttggcatcgaccgatgtgcaatttagcgaagatctgcaacagttattgcactgtggaaaaagctttcgagtttacagtaatcctgattttatcggggtacagcttggtggcgcagtgaaaaacgtgattgccatcggtgcaggtatgtccgatggcatcggttttggtgcgaatgcccgtaccgctctaataacccgcgggttagcggagatgacgcgcttagggacggcattaggtgccgatccttccacctttatgggcatggcagggttaggcgatttggtgctaacctgcacagataaccaatcccgtaaccgccgatttggcattatgctgggtcaggggttgggggtgaaggaggcgcaggacaacattggtcaagtggtagaaggttaccgtaataccaaggaagttctggcattagcacagcgtcatggcgtcgaaatgccaataactgaacaaatttatcaagtgttgtattgtcataagaatgctcgtgaggcggctctgacgttgttggggcggaccaaaaaagatgaaaaaatcggcatttgatagattagaagagtaggtcagctagctgaaataaaataatcgctacgtgcccaacgtcattggagttgcagcaaggcagcaaacgagcctatcccgatgaactgatccacgtcagtgattcgggggggcgagagccgctaacgttaattataaccaaatcaatagtaaccataattaatcgtaacagtgctacagcttgaaggaataagggcatagccgcttcggtcgttccccggagtgatttgtttatgggcaggggtacatgatgtcgtcagaagagttagaacaggtctggagcaacataaaatcagaagcaagggcactggctgaatgtgaaccgatgctggctagcttttttcatgcaacactcttgaagcatgagaatttgggcagtgcgctgagttatattctcgcgaataagttggctaatcctatcatgccagcgattgctatccgtgaagtggttgaagaagcttatcgttcagatgcgcatatgatcgtttccgctgcccgcgatattctggccgtccggttacgcgatccagccgttgataaatactccacaccgttactgtatctcaaaggttttcatgctttgcaggcttatcgtattggccattggttgtgggcgcaggatcgtaaagcgctggcgatttatctgcaaaatcaagtctctgtcgcatttggtgtggatatccaccctgcggcaaccattggttgtggcatcatgctggaccacgctaccggtatcgttattggtgaaacggctgtggttgagaatgacgtgtctattctgcaatctgtcacgcttggggggacgggcaaaaccagtggcgaccgccatccaaaaatccgtgaaggtgtcatgattggcgcaggcgcgaaaattctcggcaatatcgaggtgggccgtggtgcgaagattggtgccggttcagttgtactacaatcggtacccgctcacacgacggctgccggtgtacctgcccgtatcgttggtaaaccagagagtgataaaccctcgttggatatggatcagcatttcaatggcagcattcagggctttgaatatggcgatggtatttaaccgtatacccttcctgttttgcttgctgcaacgccagcgccaactgttttggatatgcccctaatatggggcagattagccactctgattgtggctgacacgttctctctgcgtaagaaaaatcactctttcagtaatgcacctggatagcccagttgacgccaggcctcatacaccacgactgaaacggcattcgatagattcatgctccggctatcggcttgcatggggattctgattttctgctgagcgggtaacgcatccagaatataggccggtaagccacgggtttctgggccaaataacaggtaatcattcgcctgatagctcaccgcactgtgagccggcgtccccttggtcgtcagcgcaaataagcgagccagttgtgtgctatcgagtttttcactgtccaggaaggcttgataatcatggtgatgtttgatgtcggcaaactcatggtaatcaaggcccgcacggcgtaagcgtttatcgtcccaagtaaaacccaaaggtttaatcagatgaagctggcagccggtattcgcacataaccggataatattgccggtatttggcggaatttcgggttcaaataaaacaatgttaagcatatgtcccccaataatgaggggcgcaggataccagaaacccttgttcagtgcagcggttgccagtagcggcggtgtaaaacaaaaatttaaaagcaaggagcggagtgtgtgaccagtggcatcttttatatgctggttggcacagttaagagtaatggggtatttatcatgacatcagtggggtattcatgaataacgtaaaagaccctcgctgggccgcgattatcaatcgggataaaaccgccgatggtcagtttgtgtatgcggtaaaaacgacgagcatatattgccgcccctcttgcccatctcgtcgagccaaagcagaacacattgaattctttatcgataatacggcagcagagcaagccggttatcggccttgtaagcgttgccagccaactcaattatcgcgggcgcagcaacaggtagaaaaaatcagtcaggcatgtcggttgattgaactggcagaaactccccctaagctgaatgaattggcagctcaactggggcttagcactttttattttcatcggctgtttaaagccatcaccgggctgacgcccaaaggatatgctaacgcgacccgcagtgagcgtattcgtgcacaactgtctcatggcggttcggtcactgacgctatctttgaggccggttataactcgagtagtcgattttatgcgcaatcacagcagttgctgggaatgacaccaacccgttaccgcaaagggggctgtgatgccaggttgcattttgccgttggggagagttctctgggcgcgattttagtggcaaaaagtgagttgggcgtctgtgctattttgctgggtgatgaccctgtgcagttagtgcagcaactacaggataaatttccacaggccaatttagtcggcggtgatgccgagtttgaacaatgggtggcgcaggttgtggggtgcgttgaggcacccaaacttgggttgggcctaccgttggatatccgtggcactgcattccagcagcgggtatggcaggctttgcgggagataccgataggtgaaaccgccagttatgcagatatcgcgagccgaatcggttcacccacagcggtacgtgctgtcgcaggcgcttgtgctgctaacatattggcagttgctatcccctgtcatcgagtcattcgtcaggatggggcattatcgggttaccgttggggcgtggagcgcaagaggcttttgctggaaagagagagtgtggaaaaagaggcggaagaccactgattctcaatatctgcccgaaccacattgatcgggcagatagacattgatcgggcagatagacggcagattaagatttaagcggatgcagcggtagccagacaatcaggcgtaagccacctaatgggctatcttcggcttttacccaccctcgatgctgactcaccgcggtttcaacaattgccaggcccaatcctgttcctcccgacgcccgatctcgggcttcatctgtacgataaaatggccggaatatttgttcacggtcctctgggctgacgcctggaccatcatcatcaacaatgatagtgacgccttgattatctatgctgaatgccaccgcaatatgatgatgggagtaacgcagtgcgttacgcacgatattctccagcgcactgtcaagggccgcaggattacaaaataaaggccatggccccggaggtgccgtgactaccagcgttttacccatttgttcagcctcgaactgtgcattctccagcacatcggaccaaagctcatcagctttaatgggttcgcggtgtaattcatttttatgctggctacgcgataacaccagcaagtcattaatcatgctatctaagcgctgtgcttccatttcgatacgctctaattctttcccttcaccatgacggcggcgcatcagcgcggtggccagttgcagccgggtaagtggtgtgcgtaactcatgggaaatatctgaaatcagccgttgttgagcgacgaccattctgtctaacgaactgatcatctggttgaaactggcacctgtggctaaaaattcctgtggaccggattccagttcaggatgttgtttcaggttacctcgggccacatcatcagccgcatttttcagcttgcgggcaggtttcgccaggctccatgccaaccaaagtagcagcggtgcactgatcaacatggtcgcaatcaagagcagcagcgggcggtcaaacatcagattaataaaatcagattgcggactattggcggggcgtattagataaagctgatagttatcttcgccgtccctgatggaaaagggaccgaccatttctacccggccatactttttctttttcggctgatcggcgttatccgattggccgataaagttacgcaccatttgcacttcttgacgctgtacgccaatgatacggccctcagacgtcaccaaaatcaaatgttgcccaggcggagcccatttctcaatggcgcggtgtagcctacgccaccacatgaggtcattggcaggatcattggccagttcagcttcaatatgttgttccagcatcgttccctgacgctgttcactgtcgagtaaaacagtgagttgacgcgaatcaagctttggcaccatcagcactagcatgagcactaacgctaaagtaaaccagaaaatagcaaaaattcgcgtcgttaaactgtttatcatgtttctgataccatcaagtagccgcggccacgcaacgttttaaaccacggtagcccgtctttgcggtctggtaacttacggcgtaagttcgagatgtgcatatcaatcgcgcggtcaaagggggtcaatcgtttccccagaacctcttggctaagatgctcccgcgacaccacttggccaaggtgctgagccagcagatagagcagggtgaactcagtgccggttaattccagtggttggccttcaaaactggcttcctgacgacccggattcaattgcaggcaatcaacttccagtgtaggcgcgccttgctcggcattttgttgctgttcactccaattggagcggcgtaaaatcgcgcggatacgagcaaccagctcgcgatcattaaacggttttgccagataatcatcggcccctaattccaggccaagcacccgatccaactcactaccacgggcagtcagcataatcaccggggtctgatggtgttggcgtaattctttcaaggtttcgataccgtttttacgcggcatcataatatcaagcaataacaagtcgatagagctatctagctggcttaacgcttgttcgccatcataggcgaccacaacattgaaaccctccatttccaacaattctttcaacagcgacgtcagttcacggtcatcatcaactaataggattttatgcatggttatttctcctctctgacgcaaaatacgttatcaactgccggtattccatgactttactcagctttacatgccctgaccccagttttacatccactgacgcttgtttgcaggcaggccgatagaatgcctcccattgaatcacatagcatattgaactttaggagttaacgatgcgtaaagttacaacattagttatggcgtcaatgttcgttcttggttcttcagccgcctttgctgccgacaacactaaagtcactgagggttaccacggtgacggtaagatgatgatgaacaagaaaggcgaccgcggtcaccataacatgtttgatggcatcaacctcactgaacagcagcgtcagcaaatgcgtgacttgatgcgccagtctcaccaaagtcagccgcgccttgatcttgaagatcacgaggcaatgcacaaattgattactgccgataaattcgacgaagctgctgtaagagcgcaggctgagaaaatgtctcagaaccagattgagcgccatgtcgaaatggccaaagttcgtaaccaaatgtataacttgctcacaccagagcaaaaggaagcattgaacaaaaagcatcaggaacgtattgagaaattgcagcaaaaaccagcagcacaaccttcttctgcccagaagtaagtagtagtactagtaacaccctgttttccttgccatagacaccatccctgtctttcgccctccatgatggagggctttttttgcttattgagaaacgatagctttaaaaatagtcatttacaaatttcacaaaaggcggtgttatctccaaatgcgcttaagtgtggacactttgtggacgcgtttcggcagctaatccaccctttaatggggtaagtataacggtgttttgaaggtaatcaggtgccagatgcgcgtaggccattgttggctgaatgttagcgtgtctgagtatttgctggagtgcaatgatgttcctgctattcatcataaaatggctggcaaaagtgtgacgtaacacatggggtacctaaccatgtggtaggtctggttttacgtttcgctgcgtttcaccgaattttccgtaatccatgttgaaaagtttcccactggcatttgccttcacttcttgcttcaacgctgcagatatcgccgttatatgagtgcatcaacgtactgaccgatgccgtaacaataaataatcaagagactgatattcagcaattggtggcatgcaagcactaccgtgtggcgttaatgcgtacccatgctgcccctaagtcgcctcaataaccgactgtttttacgggaaaaaggttgtcctaaagtgggaccgagtgattgctcaggaggatgctcatgattatcatcgcccgatgaaaacaacccctaccccccacgacgctctctttaagaattttatgacccagcccgccacggcgtgtgacctgctggagtttcacttgccgcctgaattgcggcaactttgtgacctgagcacgctgcggctggaatccggcagtttcattgaaaacaacctgcgtgcctgttactcggacgtgctctattcgctaaaaacgacggtgggagacggttatgtttacgctctcattgagcatcaaagctcccctgataaacatatggcttttcgcctgatgcgctacgctattgcagccatgcagagccatctggaggcggggtacgataagttgccgctggtgatccccatcctcttctatcatggaatggtcacgccgtacccgtacccgatgagctggctgcacgcctttaaccagccagaactcgctggacagttgtattgcggaaacttcccgttggttgatgtgacggtgatccccgatcatgaaatcatgacccatcggcgcattgccctgctggaactgttgcaaaaacatattcgccagcgtgatttatctgaattattggatcaactggtcatactgatagcgagcggttacactacggaagatcagctaaaatctgcgataaattacatcatacaggttggcgaaacggccgaaccggaagtgttcatccgtagcctggcccaccgcttaccggagcatgaggagtcactgatgacgattgcacaaaaactggaacaaaaaggtgaagccagaggtattgtaaaaggccgtgtagaaggccgagtcgaaggggcgcaagagacggctctgaaaattgctcgtactatgctggctaatggtcttgaccgcgccacagtaatgaaaatgaccggtctgagcgaagaagaattgactcagattcaccattgatctgcacaggcaatatcatgaacctgtccacccgataattcgaaatgaaccgaaagcccataactgtctaccgcgagatgagtttttgtcgagttaccccgcgatgcttctttattgactcatcactttctggtaccgctcccgttccatgctgatgagtacgaataatattgtcatcaataaaaataaattataaatcagcatgttaatgcaagtatttaaaaggtttctgtaaagtaccctttttagaccatagtgaaaacggcggaatacggtattccacagaccagaaattctctgggagatcagcccgttcgcatcctatcaagtatcccttccagggtcatccgatgttcacttttgttatacacacgaccacttttcagcatcaggctgtgtagcctgtaccactgttcatctgttaacattattctcggcatggtggtttgttttttttgatttgtggtgaatccaattataccggctcaccatgccgctcaattaataatctcaaaagatcaacagaccctaatagctcttaaatataatttgggatgagttatggatccacaatatgcgcgttgggttaaagccgctgcgctcagtgctaccgcattagcatcaatcttactgatcattaaaatttttgcctggtggcatacaggttcggtgagtttgttggcggcgttagttgactctttggtggatctggcagcctctctgacaaacttatttgtcgtgcgttactctctgcaacctgctgatgaagaacatacttttggtcatggtaaggcggagtccttggcggctctggcccaaagtatgtttatttccggctccgctttatttcttttcctgaccggttttcggcatttggcctcaccggagccactgcaagatcctagtataggcatcggggtaacgttagtcgcattgttcagtacactgatattagtcacatttcagcgttgggtagtacgaaaaacacacagtcaggcgattcgtgccgatatgttgcactatcaatctgacgtcttgatgaatggtgctattcttattgcgttggcattgagttggtatggttttcgccgggcggatgcattgttcgcgttgggtatcggtgtttatattctttatagcgcgttacgtatgggctatgaagcggtgcagtccttgctagaccgtgcgctgcctgatgatgagcggcagcagattatcgatattgtgacgtcatggccgggggtgatcggggcacatgacttacgtacccgccggtcagggcaaacacgttttattcagctccatctggagatggaggatatgatgccgttaatggaggcgcatgtgttagctgaacaagttgaacatgccttactgtaccgtttcccaggggcagatgtgcttattcatcaagacccatgttctgttgtccctaaagagcgtcatgcgcactgggaattataatggcttcaccaatagccgatatattgtgatgacgtttatggtaaggcagtgaaaaataccgcaaaatggctgacttgaatcaattcagcttggcgtttttgctataatatccgatattaatcccataaagctgattttctgtacggtctcttccgtgcaaagataatcggcagataaagaattctacaaaatcgcatttacaagttcagaggtagtcatggttaagaaaattggtgtcctaacaagtggtggtgatgcacccggtatgaatgctgctattcgcggggttgttcgtgccgctttgtcagcagggttagacgttttcggtattgaagatggctatcttggcttatatgaaaatcgtatgaagaagctggatcgctatagcgtgtcagatatgattaaccgtggcggtactttcctcggatctgctcgtttcccagaattccgcgatccggaagtgcgtaaagttgccctcaagaatatgcatgagcgtggcattgatggcttggttgttatcggtggtgacggttcttatgctggtgcggacctgctgacgaaagaagggggtattcactgtgttggtttaccgggcactatcgataacgatgtggcgggtactgactacaccatcggttttttcaccgcactggaaacggtagtggaagccattgaccgcttacgcgatacctcttcttcccaccaacgtatctctatcgtggaagtgatgggccgctattgcggtgatttaacgttggcagccgcgattgccggtggttgtgagtttattgcgatccctgaagttgaatttaaacgtgatgatctggttgctgaaatcaaagcgggcatcgcgaaaggtaaaaagcacgcgattgttgctattactgaaaagctggatgatatcgattcattggctaagtacattgagaaagagacgggccgtgaaactcgtggcaccgtgttaggccatatccaacgtggtggtgctccggtggcttatgaccgcatccttgcttcccgtatggggtcttatgctgtcgatctgctgttacaggaccacgattacaaaaaaggtggtttctgcgtcggtgtgcagaatgagaagatggtgcatgaattaatttctgtgtgtatcgcgccagagaataagaaaagtaaatttaaagaagattggtacgatacagcgaagaaactgttctaaaacggcaactcgctcgttcggcaagccctcgaaattgaactgatcccaaaaagttgggcagttcacattgcgagggctttttactttcagccactcatatatttcgtattgatataatcaaaagttttttattctttaataggatggaaagtttctggcacgctctgtatcaagccaaccaattaggttgattacaataatttttttgaggagtgggtcgatgcgtaaatggggtgtaggtctgtcattactattgttggcatcaggtgccattgcaaaagacattcaattattgaatgtgtcttatgatccgacgcgagaattttatcaggaatataaccaggcattcagtaagtattggcaacagcaaactggggataaggtaacagtacgtcaatcccatggcggctctggcaagcaggcgacctcggtgattaatggtattgaagctgatgtggtgacattagcgttggcttatgatgtcgatgctattgctgagcgaggtcgaattgataaaaactggattaagcgcctgccagataactcggcaccttatacttcaacaattgtttttctggtgcgtaaaggtaatccaaaacagatccatgactggtctgatttagtaaaaccaggcacgtctgttatcacccccaatcctaaaacctccggtggggcgcgttggaattatttggcggcctgggggtatgcgttagagcataataataacgatcaggccaaggcgcaggagttcgtgaatgctctgtataagaatgtagaagtattggactccggcgctcgcggtgcgactaatacttttgttgaacgtggaattggtgatgtgttgattgcctgggaaaacgaagcgctgttggctgtgaatgaagtgggtaatggtcaatttgatattgtgacgcccagtgtgtctattctggcagaaccaacggtatcggtggttgataaagtggtcgataaacgcggaacctgtgacgttgccgatgcttatttgaagtacctgtattcaccagaaggccagactattgcggctaaaaattactatcgcccacgtgacccagcagttgcggctaaatttgccaaagaattcccgcaactgaaactgtttactatcgatgaagtttttggtggttggactcaagcacagaaaacacattttgccaccggcggggtgtttgatgagatcagtaaacgctaaattaacgttctgatcgttgccgctaattctgcgcctatacctgcgaacatcatcccaaaagggttgcctgaggacggatggtaaagcaggtagttacagcaaataccgggactaccaaccgctttatcgccaacaccacatcgttgtatgttgtggtgttgaacgtttatcgctaccgcgctgcttgcaacagcgctcatagcaaaacgagtaaatagcaaaactgaggtcgaaagctcaattttacgttcagatcggctccatgccattcttgattttagcctctgtagccgcaggcgatgcaaggaagtccagtaataccttaatggctttttgctgattggttttaagggggacccctgctgaaaaatgagtcattatctgaatatccgtgggcaaaggcccaagtatgataatgccttttaaatgaagcagttcactgagttgctggaatccaagttcaacttcacccttggctaccagagaaccgacagggactcctggtgggacttttacaatgcgatctttgatttgttcggcaatgccccagcgctcgaaaacctcagtcaggtacacgccgctagggcctgttgagtaagcgatcgtattggccgctaaaacagcctgttttaccgtttcctcgctgctaacatccattatctgtgccccttctttcaccgcgatagccacgcctgacttaaccaggtcaatgcgactattgggtaaaatcttacctgaatcaatcagtttatcgattgcattggcagacaggatcaccacgtcaaaagcttcgccagcttctacgcgtttagtggcatccactcctcccactgactcgagctcgacctggtattttgattgttgcgcaaattgcgcgataacctcggtcaagaactgtcgagtggccatcgacgaaatgatccgtagggtcactggctcgtcggatggaacctctgttggtgctgccgttgccaggctgaccatactcatacacaggcccgatacaatcacgttagaatatttcattaatatatctccgctattatattgcgccaaaagacaggccaccgaaaacaggatgaccttgtcttcagtggctaagcgacgtttaaattagctgaataaatagattggtcagcaatattacttaacaaaacccaggaattgccaccaaacataaccaacagtcattgtcacaataaaacataccgtcgcgatgaccgctccagaagcccaccactgttttacgttgttataaccggcaccaaagatgatgggggctgaaccaccgccataatgtgtcaacgcaccaccgtaggagttcgtcgcggccaagacgagtgcaagggccatggggtcggcacccgcaactttccctacggtaagaaaaacaggaagcatagcaatggcatacgaacttgcagatgcaaagaaataacgaatgataatactgaggaagccgataatggttaacgctatgaatggattgtgcccaaagtcgacattgttctgtatcaaattcgccagccaatcaaacactttttctttactcagtgcacttgccagcccaatgatgcccccaaaccaaagcaacgtattccaagcccctttgttttgaagaacatcatcccacttgataacacccagtaaaatacacagtgccattgccattattgcaaccgctgttgcatcgattttgagtgtgatgccaaataattgcccaagtagagaaggcagtgcccaacccagaagagctgaaataaatataccgactaaaagcttttcattgcgcgttattggccctagttcagccaaaccttcatccgcaatttttttgttatctactttttttagttctggtttatcaagataataaccaacggcgggaacaatcagcagtaacagcaaaccgggaacaaccatggccagagcccaaacgccccagtcaagatgaatgcccagaattttggcagcgaaatcagcagccagtagatttggtgccatcgcagtgataaacataaaactgctgaccttcatgacaaagtaaatattggacatcaaataagagcccgctttctttgccgtatcaccgggttctgatcccaacgcttttactaccgacaggatgataggaaatacaattcccccacttcgcgccgtatttgagggggtcacaggagaaataacaaattctaaaaatgcggtgacatatccaagcctaagcgtggtactgccgcagaagcgaatcatgtgaaatgcaatgcgtcgccctaacccggttttaacaaaagagatactaatgccaaatgccgcaaacactaaccaaaccgttgatgttgcatatccgaccaggatttggctggtgttattaaggaagaaacccgcaaaaccgactacgcctaacaaaacaacggcttcagaaaacggttttaaaataaggccacaaatagcagccagatagaacccggacagacgccatgataattctgtcaatccttcaggtggtggaataaaccagatgacaagcggtatcattactaagatacacaacttccatatcttatttttcatgctgtagtttcccttttctaaggtgttgtaatactgaaacttactggcaagaggaatatttattcttatgactttaacgcgttgagactattgacgtaacgcagcccttttttcgccagaggggcacgcatttgatagatatccagcccgagctcgccattagccagacgctgacgtttgctcgtttcaagatctacccgtgtctgtgccgcatcagcaatcgcggtggcttgttctcttggcacaatgactacgccatcatcgtctgccaccacaatatcgccggggttgaccaactgacccgcgcagatcaccggcacattgaccgagccaagcgaggctttcaccgtaccttgtgcccaaaccgcacgcgaccacacagggaaattcatttcgcgcagcgtctggctatctcggatcccgatatctccaaccaatgccaccacgccgcgcgccagcagtgaggtcgcgagcaggtcaccaaaaaagccatcatggcattcggaggtcggcgcaacgagcaacacatcgccaggctgacactgctctacggcaacatggaacatccagttatctccgggtgtaaccaataccgtcaccgcattgccagcaatacagcgcccttgctgaataggtttaattcgctcatccaatagtccctgccgcagttgagcttcatgcactgttgccacgccatattcagcgaaacgttgtaacagggctagttcagctcgttcaatgtttgtgaccacgacccctttcatattaaccaggctcatgacagatcctccgtgacgcgagggaagaggctttgataaccttcgccatgaataatggtcttggtactggcaatgccgatgttgcgttttgcttgtaccccacgttgtaacgccactcgcgtgtagtattcccacaaatgttcctgaccggccatgcattgaatagccgcatattttttctcccatactgatgtgatatccagtaatacgtcaggcttccagccacactgttcaggctgatgcggctcgaagcagtacacgggtggcgcaccaatgatggcttctcccggtcgatacccttctgcctgagcgataatgcgagcttcttgagccaggttagccgctaggggatggtcatagttgtagggatcggccagcgaatgggtgagaacaaaatggggctgtatgcggcggaatacgtctgccagacggaacaggctttctttatctgcgcgtaacggatagtcacccatatcgaaaaactcaatactggcaccaagaacatttgccgccgcttgcgcttcggtgtggcggcttgcttttactctttcttccgtcatgtcgcctttacgccacaatttggcggattcaccacgttcgccgtaagagaggcagacaatatgaacttgatacccttgttcgacatgtaaagcgatagccccacctgcgcgccagacaaaatctgccgaatgggcgctgacgactaaggcggttttttgtggaatcattgccatatctttttcctttttttgctgctttaactgtctaggattctggcatggcttaattaatgggaaatagtgagttttattgcccaagcgacaagttttatttaagctgaaaaaattaaataaaataacgcggcgaaatatgcgaaagaagaatgatcgtaactcaataaaaattatgcaaataagagcattttgcatgacggctgaacagggggcggcttccttagcggcgctcaatttatttcgcactcagtcagcgattactcgttctattcgtgatcttgaacacactttagccatctcgttatttgaacgccacgccaagggcatgctgttaaccgatttgggcaacgttattctcccacgagctcgttctgccatggaggagttgactcggatcccggcactgctgcgccggttacaacaacgcgacgatgagggtattgaagaccttgaacccatatggttattcaacgaacggcggctacagattttcctctcgctctatcgccagcagcacgcgttgcatgtcgctcaagcactggatatcacccagtcggcggtaagcgccgcgttgaaggttttggagaagggggcgggtatgtatctgttccatcgaacaccaaaagggatgttgccgacccctgccggtcatgaaattgcgccctgtatcagccgggcattgaatgcgctccaccatattccggaagagatcaccgcacatcgaggggccttgaccggctcggtacgcgttggcgctctgccattaagccgtgcacgcctgctaccactggcaatgatcaagctgatttctcgccaccctggcataaaaatagtcactaatgagagtggatttaccgccctgatagctgaactgcgcgccggtgatatcgatttcattatcggtgcactgcgcaatgagaaaatgcttttagatatccatagcgaaatcttatttgaagaagagctgattttattggcgcgacccaaccatcccctgtctgatcgcagggtaaaaaaccaagaactaaaagatattcaatgggttttaccccgaaatcacgccccatcacgccacctgctggaagtcgcattctgcaaaatgggactcgcatcgccccagccagtagtcgaaagcggtgatcccgccgtggtacgtgcgctattgcttggttctgatatggtggcggcagtttcctcccatcaacttgattttgaagtttcagaagggatcctcataccgctgcaggtcaaccttacaggtacgcgacgcgagataggcctgatgactcgccagaaagccttgaattcacccgctaccgatgccctgatcaattgtgttcgcgaagttattcaatcgagtaacgataaataggcagttttagataaatgagttaaccatctaatttattttttgattgataagaatacttttgtcagaaaaacaaaaaactccattttagactggcacagataaaagagggaaggtcaagtgggggggagtcaagtggatgaatctactcgaattattttggatatataaaaaccggcgcttttatttacgccggtttttgtgttgtacccagaattagcttaaagcgtggattaggcttttttagctttagcggctgctttcacgataactgcgaaagcgtctgctttcagtgatgcaccgccaaccagtgcgccatcaatatctggctgagtgaacaattctgctgcgtttttatcgttaacagaaccgccgtactgaatgatcacttgtgctgcaactgctgcgtcttgcttggcgatatggtcacggataaatttgtgaacagcctgagcctgcgctggagttgctgatttaccggtaccgatagcccagattggctcataagcgataaccgcaccttcgaacgctttcacgcctagggtattcagcacggcgtccagttgtttggcgcatactgcttcagtttggcccgcttcgttttctgcttcggactcaccgatacacaatactgggatcaagccgatctctttcagtacgccaaatttcttcgcgatcaattcatcactttcttggtgataagtacggcgctcagagtggccgataataatgtattgcgcaccgatatctttcagcatttcagcagatgtttcaccggtaaatgcgccggagaggttcacatcgacgttttgagcacctagagcaatacggctaccagcaagctcatgttttgcctgatttagatagatcgccggtggggcaatggcaacgccacaaccatcaacggtgctcaattctttacgcaggccagcgataagctcgttaaccatatgagtactaccgttcagcttccagttacccataactaatggatgtcgcatgtttcttcctccaactagggaacgcgagggtcaataataatgactgcctgacaggcagtttacctgtccaacagtatagagatgattagtcgtcatggctttgcttttcgtcattaattgcagtgagattatgcttcagatagcgacagcttaatcggttcaactgcgaaggtaagccctttttctccgttatctgccaccacatagcggattgcgccaatagtatgggcatagaaaggcgagcctttgccttctgtcagcagcttttgcacgttggcgagactttgcgctactgacaatgtcggctcaaactgacgcatcagggctgccatgtagttgattgcaagcagtttagcggttttctcttcattacctttaattggtaagtaggtaatttgtaaagtttttatcttacctgtgcctttctccagtgcggttgaggcataaagattttcattaattttactggcagcccgtgtcagtggcggtgaatcttcttttaccgtgatggcatgaaattcgttgattggcagcgttggattggcgcgattataactttcgcggaatttaaccaaggtcaaatcaaacgttggagcgttgaaaagcaggtagggcgcaattggcggagccccttcctttggcgggctactgtcattggtaggatcggcatgagcgtggttgatcgttgttatcaacataaatgttattaataacaatgctgccagcaacaatattatccgcattgagacgattttttttctcatgacttaggccgccgttagaagtgtatagagaggattaaagcggtaatcagtagtcattgtcaaaattcaccgcaaagattattggttagttgcgaccttgaggtacactttgccgaaattatgttgggtaaatggatctgttcatcaatgacaatacagcagtggtgtttctcatttaaaggccgcatcgggcggcgagaattttggatctggatggggctgtggctactggcaatgctggttatttttacgttggcggggaaggagtggctcccgattcagtcagcctcgtttgcgcttgttttcttactgtggccaacggccgccgtcgtcgtcaagcggctacatgatcgtaataaagcaggctggtgggcattgttggcggtgctagcctggatgctgatggctggaaattggcagatgctgacgcctatttggcaatggggggttgggcgatttatccctacgcttatttttgtcatgatgtttatcgactgcggtgcttttcttgggacggaaggtgataaccgctttggcccagaagcggtgccagtgaaatttttcgctgataaggcgaagtgacgtttttaggttaatggccaaattgaagttaataacccaatattcgcagcagagagcaggcagtgcgtaattgtaaaacaagcgccctatcggcttgaaccgcactgctgcggtgtgggtgctttacgcttctgtctattctcacggctcactatcgagtcatcaatcttgtgtcattgggggccagccgcttgggcgagcagtaacgttttttctttaaaaaacagtttgttaatgatatttatcatccactgcaaatactgtcatccactacaaatactgtcattcactacaaatactaccgcccaccacgaatactccccatcgcccatactgtctgtcaccaatactgctcgctggtcatatgccccggtttacggcgcagatgtttacgcatttcgcgctgttctttcagtaattgctgggtatcacgcaccatttgtgggttaccacacagcatgacatggctgtctttcgcatcaatttttaggccaactgccgcttccaaagcaccattttcgatcagcgccggtacccgcccagttaaagaaccgggtgattcttcgcggctcacgacggtttggatacgcagcttgccgttatagcgttgctcaagctgttgcatcagcggtaggtagctgaggtcatgggcaaagcgtgcggcgtgtaccagtaccaaatgcttgaaacgctccaaatcttgcccttcctgtaaaatcgacaaataagggccaatggcggtaccggttgccagcatccacaaggtatcgcagtcgggaatttcttccagtacgaaaaaacctgcggcttgcttggtgatcatcacttccccccccacggatagttgatccaggcgtggactgagttttccttccggtaccgtgaccagataaaactccagattatggtcgctcggggcattcacgtaagagtaggcacgctgtacacgctcaccattaatatccaacgccagtttggcgaactgcccggcggtaaacggatccacgggtgcattaacctggagactaaacagcgcgtcagtccagtgctcgatgtgagtaattttgccactaacccattcagccataattataattcccgttatttacatgcttgtttctatttacatacttgcttttatttacagacttgtttgaagttatctccgaatcatctaactgatgtaaactttacggcgcttttacgagcgccgtgcagaataaaaatgattgctagccggtttacagtaagaactcgtgcaatgccgggtctttgcgatccaggaaatgggtcgagcggatgcggcggatagtgcgtgatttaccccggatcagcagtgtttcagtggtcgccatattccctttacgatagataccttctagcaggtcacctttagtaatgccagtggcagagaagataacattatcattacgggccatatcaccgagctgcagcacgttgcctgcttcaatacccattgatttacaacgtaataactcttgttcgccgatgcggcggttatcttcactgtcgcccttcacttgatggcgcggtaacaagcggccttgcatatcgccatctagcgcacggatcactgcagcagaaatcaccccttcaggtgcgccaccaatgcagtacatcacgtccacttcgctttctggcatacaagtcaaaattgacgcagcaacgtcaccgtctggaatggcgaacacttttacacccagttgctgcattgcggcgatgatgccgtcatgacgcggtttagccaaggtgatcacggtcaaatcagccagcggtttattgagtgcggtggcgatattgcacaggttctgttccaacggcagattcaggtcgatagcccccttggctgccgggccaaccaccagtttttccatatacatatcaggggcatgtaagaatgtgccttggtctccgaccgccagtactgccagtgcattggcttggcccatggccgtcatccgggtcccttcaattgggtcaaccgcgatatctaccgcatcaccttgacccgtaccgacatgctcgccaataaacagcattggggcttcgtcgatctcgccttcaccaataacaatccgcccatcaatattgacttgattgagcatgatgcgcattgcctgcaccgcagcaccgtcggcagcatttttatcgccccgacccagccacttataacctgccaatgcggcggcttcagtcactcgggaaaactcgatggctaattcacgtttcatggttagacctgttgattgcggaatagaaaaactgaatataggcaagaattctatcacctttctaacttgaagccgcaaaggtgttagctgtactctttttacccgcataactgccggtcatgtttctcacaacgaaaaacgcgccatcggggggatagcgcgttgtgtttggtttaaaataggctcagtttaaaataggcttagtttaaaaccggttctgtttaaaacggactggctaaaactggcgggctattactcgtcgtgctcttcccaatcccgggcgcgggccactgcttttttccagcccttgtaacggatatcacgctctgtggtttcaatccctggacggaattcgcgttcaatgcttgctttactcttcacctcatcgaggtcatcccagaagcccgtcgccagacctgccaggaatgcagcacccaatgctgtactttcacgaatagcagggcgctcaacacgggtacccagaatatcggcctggaactgcatcaggaagttattagctactgcaccgccatcaacacgcagtgatttcagccgtgcgccggagtcagcttgcatggcatccaagacatcgcgggtctgataagctatggattcgagcgttgcacggataatgtggttgctgttaacaccacgggtcaggccgaaaatcgcaccacgggcatacgggtcccagtaaggagcgcccagaccggtgaacgctggtaccacatacacaccattactgtttttcactttggtcgcgaaatactcagaatcggtggcatcgcctatcaacttcaattcatcacgtagccattgaatggaggcaccaccaataaatacagccccttccagtgcataattcacttcaccgcgtgggccacaggcaatggtggtcaacaggccatgagtagattgaaccgcttcttcaccggtgttcatcagcaggaagcaacccgtaccgtaggtattttttgccatgcccggctgtacacaaagctgaccaaacagagcggcttgctggtcaccggcaatcccggcgattggaatacgagtgccacctttgccaccgatattggttttgccgtagatttcggaggatgggcgaacttccggtagcatggcgcgtggaatattcagcgctttcagcatacggtcgtcccactccttggtacggatgttaaacatcatggtccgtgatgcgttggtatagtcggtgacgtgcacacggccttgcgtcatattccacaccagccaggtgtctacggtaccaaacagtaactcaccgcgttcagcgcgctcgcgagcgccctcgacgttatcgaggatccatttcacttttgtgccagagaagtagggatctaccaccaaaccggtgttgtggcggatatactcttccagcccttcttttttcagtttttcgcaaatatccgcagtacggcggcattgccagacaatggcgttatacaccggcttaccggtcactttatcccaaacaatcgtggtttcgcgctgattggtaataccgatacccgcgatttcatcagagttgataccggctttggccaggacttcaatcagtgtagagctttgggtcgcccagatctccattgggtcatgctcaacccagccagcctttgggtaaatctgagtgaattcacgctgagaaacactcacgatatttgcattgtgatccagtactaccgccctggagctggttgtcccctgatcaagtgcgacaatgtattttttttgagtagtattttcagttgtcataataagcctacttttaagttgccatttatccccttcgtacttgaagccgcagggggatagttactctgattactcggcctctgtaggcgcgttcaaaacggtttataacccatttgttgtgcgtttgctgcctacatgcgactccaatgacttgtgtatatttcagtatctattatttatgctttacgttctgtggttatcgttgtggattcttcatcctcaagggtacacacatcacagggcaggtggcggccaattaaggcccgataaccaaatgcacccaacaaagcaccgacgataggcccgaagatcggtaccaggaaataaggaatatcgcgcccaccagtgaaggcaatatcaccccagcctgccagataagagaatgcttttggaccaaggtcacgtgctgggttgagtgcgaacccggtcagtggccccattgaagcaccaataactgcgatcagaataccgatcagtaggggggccagcgggccgcgtggaatgccgttaccatcatcagtcagtgccagaatcagacacatcagaatggcggtaatgactgtttcaaccaagaaagcttgaacgacagaaatatgtggatttgggtaagtagagaagatacctgccagttggaggctctcggtgctgccacgcaccatctggtgagtttgttcaaaatcgacgaacaggctgtaatacaggccgtatactaacgccgcggcacaaaatgcgccggcaacctgtgccacgatgtaagggagaactttacggcgttcgaaacaggcgaataaccacaatgcgatggtgacggccggattaagatgcgcgcctgaaatggctgccgtcaaataaatggccatagcaacacccaggccccaaatgatactgatttcccactgcccaaaactggcccctgccaacttcaaagcagcaacacaacctgcaccaaaaaatatcaatagcccagtaccgagaaactccgcaatacattggccttttaaggtagaactagcggtttggctcataataatgtcctacagacagagatttatagggtatttcttgtttttgcccttcgagcagtgaaggggataatgtaaatttatcgttaacgagcgaaaacgagaagtagcgaaatcaaaatatgtgttattcgtcatgaaatgagcgttttcgcgtaattttagggcgttaagggactttaaaagtgtgatcggaccagtgattttttgtgaaaatgttaaaggggtgtatcgcatcaaaggggcggtcatagatatttttcagtctttgctgatagtcacatgcaggaaattgctacagagtgtggtttgcactggtatggagctagacagggcgggattggctacatacaatcggtttcatagagcaccggtttcatagagcaccggtttcataaagcaccggtttcgtcgggcaccatttttatgacgtattgtttttacgaagttatcgctttcatcaagcagtatcacctttataaaggtgcgtattagaacaccgcgcttatcaccgtcgttcgatgagtatatagcgcagtaagtattcgcagcagtttcatccgccagtggttacgatgagtttttggcaagtaatgatgactgcgcccaagagatgtacgccttgctaccataagaggaccaaagaatgtcatttgaagtatttgagaaattggaagttaaagttcagcaggcgattgataccatcacgttattgcagatggaaattgaagagctgaaagagaaaaataacacactgacccaggaagttcaggatgctgctggtagccgtgaggcattagtgcgcgaaaatgagcaactgaaacaagaacaacatgtctggcaggatcgtttgcgagcactgttgggtaagatggaagaagtctgagttccgattgacttccgttgccactagaaatcgctaacgcgtttttgatcaaggttggttgctgagcatagcgaggctagccttaagtcagcggaaataaagtaaagggcgatatcagtatcgcccttttctgtgggtgcgccgatgctcgcggagcggggggcaatatcacaaatgttattgcaggatcaggcgccttatttacaaggccaatgccaatattttcctattcgtgccccactcagtcgcgcaacgctgaaaattccgttatggctaaatcatccctcatccctcatccctcatccctcatccctttgcctgtcattatgtaaataaatcattacgatacgttttgtttttccagattaataatacgctgggcactggctatcgttgaaggacgatgggcgataaaaatacgggtgatcttcagtgaggctatcgcattattgatatgtgcttcgtttgctaagtccagatgacttgttgcctcgtccagaaacagtaaactaggttgacgatacaacgctctggcaatcaataaacgttgcttctgcccgcccgataaactgcctccaagctcactaatcaacgtttcataacccatcggcatatgcataatttctttatgtatattgcaatgattagcacaggaaagaatacgctgctcatctttgttgacatcaaaactggcaatgttgtcagcgatggaacctgcgaacagcttgtcatcctggagcacgcaggcaatgcaatcacgataattattcaggccgaccgtcgttatatccagcccatcaatcagaatatgcccctgtgaaggtgtcagcagcccggctatcactttcatcaacgtggtttttcctatacccgatgggccagtaatcgccacactctcacccgcttcaacgtgaatgttcaaatcagaaaaaataggttttgacagattgtcatattgaaaagcaatgtttcgagcttcaaagaccgcaggttgattgggtgaaagcagttgtctgggggtctgttctttttcggtttcggtgaaaacaatgtcggcaatacgctcactgtgcaaggcaagcatacggagttgcaacaccatattgatcaagttggttgcccgatcagaaaattgtccccgataagcattaaaggcaacaaacatacctaatgtcatttgcccatcaatcaccatcgacgcgcctagccataagatgacaacttgatcgatggtgccgatcagtgtgtttacgccgccaaaaaacatatctaacttagtcagtcggatattggcattggtcgtgtctatgtttagattgagccaaaattgtgagcgtgttgctgccagccccagggccttaagcgtactgatgccataaagtgtttccataaaatgagagctggctttggcattttttacaatttgctcttcggaagcctgacggtattgattataagtggcaaggcgcaggatcatgtacatggcggtaaaaccaagtaccacccaaaccagccagccaccatacaaaaacatcatgataaacacgccaatagacattagaccgtcaatgatgccgttgaccacattgttggttaatgttgaacgtatgatatcgagggagccaaaccgtgactgaatatcgcccagtttacgtttttcaaaataagccaaaggtaatttgagtagatgatcaaataaacccgccttccattgcacatcaactaaagaccccataaccagcgatgtccacgatcgcaacatacttaaaaacgtgcggaacagaataaagaaaagcaggccgatacaaatcaatgctaataggtcatggtcctcggcaatgatcacatggtccatgaccaactgagttcctaccggtagcagtaggttaatggcctcgaccattaacgataagcaaaatatttttgtcagaaagccaggtaagccgctgatattacgcatcagtgataataggcttaaacgggtacggcttttttggcgggtaaattcactgtcaggccataattccagtgcgacaccggtaaaatgctgtgacatctcacttaggctgacagtacgccggccaaatgccgggtcgtgaataataaaccgggtgcccttcactgcaacaaggacgacaaaatggctcatatcccaatgcaatatacagggtgtttttaattggcgtaactcatctaaatccagtgataaagcacgggttttaaacttaagttgtgctgatatattaattaatagcgctaatgttgcgccatgagaagaaataccaaaacgttggcgtaaattaaataaatctatatccatcccatggtagcggcatgccattaccagacaggcaagtccgcattctgctgcttcggtttgaagcacctgtgggactttacgacgaaagctaaaattcagacggttttttatctcgttaaaatgcgtatcattcatttacaggccccgttacacttttcttgatgtcatagaatggagatagcatccattgataaagaggccttttttcaaggaataacgtgacattagctttaaggccattggatagcattaaaggtttagactgataacgaaaatgaatatcgtctagtgccacgatgactttatagtaaggctcaatgagtccaccgttcgggagccgcggtgcaatgttgtatgaggctatttcttgttgtgaaacggggacattagagatagagattatacgcccaggaaattgaccaaacttttcaaaggggaaagcgtcatagcgtatattgactttgtctccagtatttatataagggacgctattgtttggtacccaaagcacaagacaataatagggattatcagaaggcgtcaattggaccaaactgtcatttacgttgaccatctgtccttgggtcacactcatattttcaatcttgccatcgcttggcgaattaatgagtaacatgccactcgcatcaacttcagccaattgacgctttaaatcacctttttgaaataaatactgagagatatcattatcaaaatctgatgctcgcgtagagatttcactttcaagttttgctatctgtaagctttcttgtatcagttgagtattcaggctttgaaaggcattctgttgttgataaaagagggaacgctgattggttaattgatctttagtaattagaccctgacgttggtaagtaccataactggccattgtacgccgcatatcatccattcctttgcctgcgttatcgaccagctcttgggatttcttatgtgccttttggtattgtgcgagctgctgacgtaaattaagtagcgtaagttctttatttttctgtgtattattgatgatgctatcaatttgagaaagttggttatttattgcttctaaagagttaaggctaacattacctgaaaaggtcgttcgactgacatcaatttgatataagtgctgacctttacggacaatatcacccacttctacccattttttggtaatgaatccttgttggggagaaaaaatgtttatggggtgaggctgagaaataacctcaccattaacgtttattctacgggtgtatgttccataaatgataagagtaattaataacaccaaaaagatagcacataaagcagctatgaacgttgtggaataacccgaagttaacagcgccttccccaaccattttgttctaatatactctaccgcgtcccggcggaatatctgattgctgctcattcctcgctccgttatacccatcatttcaaatcaacatatcacaaaaaatagaaggtttaattgaatcattttcacgtaactctatttcggtatatttaattatttacgaattgcagtttgattttttattattttgctattacatttttgttgagcgcttttatgctcaccatgaagaactaacttaattttatctatataggagtctttctgtgaaagaacttacacaaacggaagtgatggaagtttcgggcgcgggtattgtttctgatgcaggtaaagtgctgggttctggctttggtgctctgattgacgcgggtgcatctatctttggtattaagccaaatgctagcgcaacaatcggtaaaatcggcgaaagcatcggttctgcttttgatgcgggtatttccggagttaaacaattctttggtttatcagcaccacagcagtaataagtaaatatgccagcgtgaaagcgctggcatattaattgaaagggatctggacagtacgcattattaagtagtcatgtttgtagggtgtttaaaaacagattattcctattttaagcgatgggataagtagcgtaatgaaattttaaatgcagaattatcctatttaaatagatgaaaattgcttatcgaacaatacgctttataaatttatggatatatgctgttttctacagtgagttttttgggttcgaactgtcacattatctttccactgccgatatgattttttttggtgattatgagtttattttatatcactaatgactttagtttaaaaaatcagtgtcctaattaaacacatcaaatttctcccttcttttatttttcagtgctggtatctatatcaataaaatactaaggataggtgttctcatgccatgaaaaatttcagataaacatcttttttatggattagcgaacaactcgcaaggcgcgccaaatgggtaatagcacggtggtggcgggtataaacgtattatcgtggatttattattttcacggcccgatacccacagtgattatctatttactgacttaattcattcacatcttgatgaggttttttgatgcaaagaggctgctgttttctccgtagtacaactaccgctggagtggctttgatcgttgccatgacgctatcggtatcggcatgggcaatttcagaacaggcaaagtcagaacaggccacgaccgtaccaaataatgatatcgtctgtcatgtggctcacctcaacgcccgttttgacgataaagaggggctattcgaaggtgcatcacaaagcggtactttgctgatattacgtaatattagcgctcgagcctgccaggttaatgcaatgccagtgatcagtttcgaaggcgcagttggccagcagttggccgtctttcgcaaagtaccgcgtgggatgcggcaggagccggtactctcacccgtcactgttgcggcgggagctgaagtcgcggtgcaattgcgttgggtggccagtgacgcgttcgatgggaataactgtgtaacacctgagaaagtggtggtgaccctgctaggggggacattgcgtttacctttcggccgacagatgtgtgcggcatctggtgatactgaattcttcagtcaggcaccagtaggcccagcgaccaatgaggtgcaatgagtatcgggagggggcaatattacgccaggatcgcaatcacagtggataggagaagaaggggaaccttctcctatctgtgcactaatccccgtcagacagatattatttagggtatgttattcaatatccaggggatcttccgataagataataccggtgttatcggcataaagatggtcacctgagaagaacgttacaccgccaaaattaacacggatatcgctctcacccacaccctcatcagcagccccgacgggtattgcggccattgcctgaatgccaatgtccaactcggccaagtcatcgacctgacgcacggcaccgtaaacaacaatgccttcccactcgtttttcaaggctaattcggctagctcagcattgattaatgcacggcgcactgaaccaccgccatcaacgaccaagacacggccaagaccattctcttcaagcaggtcaaacaacaagccgttatcttcgaaacattttacggtagtaatcttgccaccaaatgaagtgcgcccaccaaaattggagaacagtggttctaccacgtttacctcttcatgatagatgtcacagagatcggaagtatcatatttcataggattaacgtctggttgcggctgggagattgagtatatccttttctggccgctgttggcaaaatcatcaattgttaaatttattcaagttaccttgagccgctaatggcccggagacctttttatgataaacaagccgtattaactgaataccagacccacagcaaacaggatattggtcagtaaagcggctttcaccatctgctcgagcatagggcgcatacctgctgcggtagggtcccgtaaaacaaacagcgcatgttttcccagtaatgggatcgctaataaaaagatccaaccgtgccaactgtgcagatggagaatgctgaagagtgccaggcagaagatggcggcactgattaacagcgcatgataatagcgtgctacgacaggccctagacggactgccagcgtatttttgccatttgctttatcattttcgatatcgcgtaagttattaatatttaataccgccgtggccagtaaaccacaggccgtggccggcagcatgacgatgctatcaaagtggccagcttgaagataataggtccctgcgacgcttaaccaaccgaagaataccaataccgaaatatcacccaatcccatataaccatagggttttctccccacggtgtaagtaatggcggcaacaatcgccatcagaccaagcagtaaaaatccaagaatatcgctgggcttttcacaggcgacggcaatgagggcgatacctgaaatgattgttaagatcacggtgataattagcgccactttcatttgctggtggctaattatccctttttgcataccgcgtaatggcccgatacgttcttcggtatcgctgcctttcaccgcatcgccatagtcgttagccagattggatagaatttgcagtagaccggcagttaatagggctaatagtgccacggcgggtttaaaactatcgagccagacagccagggctgaaccggtaacgatagaggcgaacgccaatggtagggtgcgtggtcgtaggctttccagccaagcctgggtttggctggtgttgattgataggctcatttttcgcttcattcaataggagtctggtccgccttaatctcggcgtgtaagaaaacgggatcatgccaaatggaaataatgttaataaaattatcatgtcaaaaaattatgacgttatcaaaatcataatgcgataagaatcataatacgataaaaacaggagtgggaggcgatgcctcccactcgggatactccatatggatgattttatccagcctaggcggataaagcgaattataggataaaacggctcaagtcttcatccgcaaccagctcatctaagtgcttaccgacgtattccgcgtcaatagtgatagattgaccactgctttcgctggcgtcataggaaatatcttccatcagacgctctaacactgtgtgtaaacggcgggcaccaatattttcggtacgttcgttcacctgccatgccgcttcagcaattttacggataccctcgcgagtaaactcgatggtaacgccttcggtcgccatcagcgctttatactgttcggttaatgaagcacttggctcggtcaagatgcgttcaaagtcatctgttgtcagcgcttgtaactctacgcggattggcaaacggccttgcaactccgggatcaagtctgatggactggaaacctggaatgcgccagatgcaataaacagaatatggtcagtcttcaccatgccgtgcttggttgagacggtacaaccttcaaccagtggcagtaagtcacgctgtaccccttcacgggagacatctgggccggaagtctggccgcgtttacagattttatcgatctcatcaataaacacgataccgtgttgttcaaccgcatcaatcgcttgctgtttcagctcttctggattaaccagttttgctgcttcttcttcaatcagtagcttaagtgcttctttgattttgattttgcgcggtttctgtttctggccagcaatattctggaacatggattgtaactgattggtcatctcttccatgccagggggggccataatttcaacccccatcggggccgcagccagatctatctcaatctctttatcatccagttggccttcgcgcagcttcttacggaaagtctgacgggtggcagaaggctcctgtgattcatccggtacgccccagttgtttttggcgggtgggatgagcacatccaaaatgcgttcttcggccaactcttccgcccgatagcgcattttctcgatagactgatggcgaaccatttttacggctgcatcggttagatcgcgaatgatagaatccacttctttaccaacataacccacttcggtgaattttgtggcttcaactttgatgaacggggcattggccaatttagccagacggcgggcaatttcagttttacccacaccggttggcccgatcatcagaatatttttaggtgtcacttcgtggcgcagctcttcgttaagctgcatacgacgccagcggttacgcagggcgatagccaccgcacgcttggctttgtcttggccgatgatatggctatcaagttcgctaactatttcgcgtggggtcatttcagacatattattctatccttacgctctgtacgttaattatgtactgtacattaattatgcagtgcgttaattacgtttagtatgttaattcttcaatggtttggaagcggttggtgtagatacaaatatcccccgcaatactcagtgatttctcaacgatatcccgcgcacctaattcagtattttctaacaacgcacgtgctgccgattgggcataaggcccaccggagccaatggcaatcagatcatcttcaggttgaaccacgtcaccgttaccagtaatgatcagcgaagcggtctcatcggcaaccgccagtaacgcttcaagcttgcgcagcatacggtcggtgcgccagtctttggctagttcaacagccgctttcgtcaggtggccttgatgcatttccagcttgcgttcaaataactcgaacagagtaaaggcatcagcagtcccccccgcaaagccagcaataaccttgttgttataaagacggcggacttttttggcattacctttcatcacggtattgcccaaagtgacttggccatcgccaccaataacgacatgaccatcacggcgtacacttacaattgttgtcacgagcggaccctcgttgcagactgaatgagtccccgtactgcctgttaaaaaacagtacggagtatattgagattataaatgggggaggattaagacttttcaacccccaacagagaggggaatgcatcctgattgacctgcaccttgtaaacgctgcaaggctttatctgcggcagccttactattgtaggggccaagcaccacgcgattccagccaccgcccgaggtaatacggctttcgatacccgcaaatgccaattgagcgcggatagattctgcctgatcaacggctttgaatgagccacattgcaccatccagcgttgtgttttttctttctctttttccactttaggcggcgtaacggcctgagtcactggcgcggcgggcggtgtacgcacgggggccggtgcttgaggttgtacaggaatagtggtttgacgcggcggagttaccggttgcggctgtacactggtggccggtggtttgatggttaccgctgaacgtggtacctgctgcataccttggttatagggaacctcagaaagttgcgtcggttgttgacgcatatctgcctgcatctgctccagtaactgacgttgttcattggtcaactctgttttggcgtttacttcaccccctgcagagggttctgttggcatgggtacgccaatctgacgattttccaactctttaatataacgccagcgttcttccggttttggcggtagcccattcccggtacgtgggtcatgatttggcaatagcggaagttcacccggtttattgtgggtgataaaatagaggccgccaacaaacaccactaatagcgcgacagccagtgccatcacggttttagatactattggagcactgcgttttttccggctggtgcttttgcgccgcgctcctgagcgccctcggcttacataatctctttgtgccacaatcgtttcgctgcgtcgtaatgatggaataagtccgtcatgttactgaacccttgaatatttgcctagtgtttaggcgcagcagtactttccctgatgattaattcggtatctaacaagcgggagccactttgtactgaatgcccttgcagttgctccagtaagagtaacatggcttgctggccaatctggtaacggggttgtgcgacggtagttaatggggggtcacaaaactgtgacagcttcaagtcatcaaagccaaccagcgagacatcctgcgggatacgtaaccctaattgcttcgcctgccagatagcccctactgccatgacatcattgtgagaaaatattgcagtgggggggtggggcagctccataagagccgcaaagctttgggcccccgcttcgtagctgaaatccccgcgtataatatagtcattatcgacagtaataccattacgacgcagtgcctgaatataaccttgtaaccgataatggctcagcggcaggctttctggcccggcgatacaggcgatgcgtttatggcccaactcatgcaaatagttaacggcttcataagcggcggtcaggttatcgatatgtacggtcggcagctccaactcaggagcaaactcattcgccatgaccatcgggggtaaatttcgctgctcttctttactggcatcaaaaggcaggttagagcctaatagcagcatgccatcgatctgtttggtgataatcagattaacaaatgtgcgctcttgctgggtttgttgtgcgcaatcaccaattaatatcagatagccttgctgggcggctgcgtgttcaatgccctgaatgacatcggcaaaaaatgggtcactgatatcgggtacgatcaccagaatcgtacgtgattcattacgcttaatattacgggataaagcatgaggagaataaccaacagccaaaacggcttgttccactttttgtcgggtcacggttgaaaccttttcagggttcatcaacgcgcgagacacggttgctgttgatacacctgccatttcagcaacatctttcatcgtggtcattgtgaattctttcttattttccaacgcccttctccttactctagctccgagccagtaagcgcgctcatagacttttatggccgtgttgtttcggttaaatactgacttgccgtcattctatacagatagtgggggtaatttgttacctaatttgcataaaaaatgtgacgtaagtaggttttttcgaactggctcgcagaaaggagggtaaacgattgcttcgtggtgacgatcagacaataaaagatcgggcgaacccctttttcttgacgctgcaaggggttcgccatatcccctcacctgaatcactttcgtgtcagttcatcgggatttattcgctgttcacctaccgtgttaatgattttgggtatagatatcaactatcgataggatcgacatctattgtccatttcactttgcgtgcctgaggtaaggtactgattaatggctgagaggttttaatcagccgttgcagcagttgccgtgagggatgttgtagcaataactgccagcgaaagcgcccaccccgtttggcttgtaacgccggaactggccccataatccataacgcctcatctttgagggggctggcctccagcaaattacgtaattgttgcaggaagagggctgattgttggttatcgtgatcttcactgcgcacgataatatggctggtatagggcggtaaaaacacgcttttacgctcttctagcgcttgtttggcaaacgcatcgtagccctgctgtaacagaatttgcagcaggggatgctcggggtggtgagtttgtaaaatcacttccccttgcttgcctgcccgcccggcccggcctgagacctgcgtataaagctgggcaaagcgctcggctgagcggaaatccgctgaaaacagcgcgccatcaacatccagtagcgccaccaaggtgacgtcagggaagtggtgccctttggccaacatttgtgtaccaatcaaaatgcgtgcaccaccttggtgaacatccgccaaatgttgctccagcgatcctttacggctggtcgtatcgcggtcaatgcgggttattggtgtctcaggaaataacggtgccagttcattttccaactgttccgtccccacgccaacggagaccagatgagtcgatccgcatttagggcattgctgaggcacaggccgttggctgtcacagtggtggcaacgtaactgacggtggttttgatgcagcgtgtaatagtggtcgcagcgctgacattcggcaatccagccacattcgtgacacaacagggcaggtgcatagccacggcggttgaggaataaaatcacctgattacccgcttgcaggtgcgttttcatccgtttcagcaggggttgagagaggccgactttcaatggcaggccttttagatccagcaaatgttgtgccgcaggtttggcactccctgcgcgtttggtcagggttagctggcggtatttacccatttggacgttatgcagagtctcaagcgcgggagttgccgtccccatgacgataggaataccctcttcgcgggcgcgaaataccgctaaatccctggcatgataacgccaaccttcctgctgtttataagagctgtcatgctcttcatcaataatgatgacgccaaggcgtgaaaacggcgtaaacaaggctgagcgggtcccaatcacaatcgccgcctcaccactacgtgcccgcaaccagacggataagcgctcactgtcgttcaagcctgaatggagaacctcaaccggtgcgttaaaccgttcacgaaaacgggcgatggtttgtggggtcaggccaatttcaggcaccagaattagggcctgacggccctgcgctagaatgttttccagcacgctcaggtaaacttcggttttacctgaacccgtaacacctgccagcaaccaagcggcaaattggttatcttcgctacgaatagccccgacggcggtggcctgttcagtattaagccgtaggcgttcccccagtaccgaaaaactgtgacgccagtcggtggttgtggcttcctgcgcccgtagatcaatcaaccctttactgcgtaatgcctgtaatgcactttcagttaatgccatttcattaacctgatggcgataaaccggtttctgcaataatgcagcaagcgcttgctgctgcttgggcgcgcgttttaagctttctggtggtgtagcgcggccttgctcggtgacaaaccattgccataagggcgctgattgggcgggtctcccctgacgtaacaagatcggcagtgcatgaaacagcacttcacctatcggataatggtaatactcggttgcccagcagagaatgcgccacaggctaggggggaataagctgtgattatctaaaatggcatcaatggttttgagttgttcaagcggaaaggtgctggtatcactgagacccacgacgataccaatcgctttgcgtttaccgaatggcacactgacacgggcccctacgacagggcaggccatggcactgtctaagcggtaatcgaaggtacgggccagcggtacgggtaatgccacttgaacaactgacatatgatgtcatcctgaataaagagattggcctgaataaaaaaagattgaacagtttacaccgcatacttcacaatgtgcggattcgattgcgcggtttcgtcaaattctgtatgattcgccgcctttgatataatttgatatcaaatcctgttaaccatcgttgcttattttatcaacgatggttatttatcaatcgtgtggtgtctggcggaacagggctggatagcgacacggcctaatatagaggtttccatgaaacaaggtatccaccctaaatacgaacaagttactgcttcttgctcttgcggtaacgttatcaagatcaactctactgttggtcatgatctgaacctggacgtgtgcggcgaatgccacccgttctacactggcaagcagcgtgatgttgcttctggtggccgtgttgaccgctttaacaaacgtttcagcgtgccgggtgcgaagaagtaattatcgcccgtcagataaaaaggcgccttgggcgccttttttgttgccactctaaccaccttttacggaagtcgtgatcgttttatggcgatgatgattattttatggggatgattgttttatggcgatgattgttttatggcgatgattgttcgtcgcatcaggtcgtctataacccccattcagcacccaacttagcctactcgttatcacgtcgccaattttccctctgcctgaatccatgagatgattaggcataaataataaataaatttaataagttaataatgacgtggaccatttggtgagtttgacacgagagataataggttagcgacgtctaattgttattattaaattttatgacacatacttcgatgattattttgtgcgtaaagaaaaaatggctaagcacaattgttatgctgaaccattttttgtagtgaaagcgttaattatagtgaaaacgttaactgcagtaaaaatattaactgcagtgaaaaggttaactgcagtgaaaaggttaattgtagcgaaaaggttaatcttcagctttcaattgatctcttacttttttgaacaatgaagcagattcagtatctgaagacattgcactgtcgcgggtattcttttgtacggcaatagcaccaaacagggtcataaagaacgtcaccccataaaagcctttttcactcagtgctaaagtggcattccataggccgatacacagcaacagaacggcgacgataaaagcaacccaacataaaccgtaataaattgaagtgattgccaggccttctagcttgtcacggacggttttttgcaaagaaacggcggagaacaggccgagtatcaataccgcgaaataataacctcgctcgtttaattgcatatctgcattccacagaccaatcaggaagataacaaaaccacctaatagcgctgaccaagaggctgcggtaaaagcggcggaaggtttcgcataatttgggttcatatttaagtccattcattaaattagacatcaaattttttaatggaaagtgagtgatctctaaccatttaaaaactggttatatcccaataatccgtagcagtaaaataataattgataatatgcttttttatcgagatatacatggagggatggtatgtgagaatattcttatacaatatgtcgatatagctaagactattcttgagttatgagtaaatataaagaagggaaatacagataactaccacagataatacatttttatcaaaaccaaggcgcttagcgtgcttttgtgtattctgccacctggattcacggtgattcatgaacccaggtggtagctggaaatcaatattcccaggtgtcagggtcaacacccaattcacgcattaaaattttcgcggcttccgggatctcatcactgcgttctttacgcaggtcttcgtcattcggtagcggctggccagtaaatgcatgcaaaaaggcctcacacaacaattcactgttggtagcatggcgcaggttattcacctgacggcgggtccgctcatcggtgaggatttttaacactttcaacggaatggataccgtgatttttttgacctgctcgcttttcttgccgtgttcagcgtaagggctgacatactcgccgttccactcagccatgggataccttaaatttgtcggaaaaacacaatgttctgaaaaccggctaattatgcccgattttcactgttctcactaaataaatgtcgattttactggatcaacatcaccgaaatacccttagtgcttacgttgttgctgctcttactcgctcgaatcactgacttgagccagttcactcgttgctatgctacaacgctaatgacgttggatataaaaacctactttaaatacaaagcctctataattttagcggttattattccattgctcaatctatacgcaaagaagtttagatgtccagatgtattgacgtccgtattttgtgcgtctactctggcgtaacattttctcgatcccggctggtggaaatcaatatgacgcgtaaacaggcaacaatagcagtccgtagcgggttgaatgatgacgagcaatacggctgcgttgtccccccgattcacctttccagtacttacaattttattgattttaatcagccgcgcacgcatgactattcacgtcgtggtaatccaacgcgtgatgttgtccaacgggcgctggcggaattggaagggggggccggtgccgtcatgaccagcagcgggatgtcggcgattcatttggtttgcactacattcttacagccgggcgatctgttggtcgctccgcatgactgttacggtggcagttaccgtttatttgacagcttgagcaagcgtggtgcgtatcgggtgttatttgttgatcagggcgatgaagcggcactaaaccgcgcattggcggagaaaccgaagttggtcttgattgaaacaccgagtaatccattgctacgggttgttgatattgccgccatctgccaagccgcccgtgctgcgggcgcactgacggtttgtgataacaccttcctcagccccgccttacagcagcctctctctctcggggccgatttagtggtgcactcctgtaccaaatatctcaatggtcactctgatgtggtggctggtgctgttattgcgaaagatccagaactggttgttgagctggcatggtgggcaaataatattggtgtaaccggtgctgcgtttgacagctatctactccttcgtggtttacgcacgttatcaccacgcatggctcaacagcagcgtaacgcggatgacattgtgcgttatttacagcaacagcctttagtgaaaaagctgtatcatccttccctgccacaacatcccggccacgaaatagcctgccgtcagcaatcaggttttggtgcaatgctcagttttgagctggatggtgatgagcaggtcatgcgccgtttcctttctgcccttgagctatttaccttggcagagtctttggggggggtagaaagcctgatctcccatgcagcgaccatgacccacgcgggtatggcggcagaggcgcgtattgccgcaggcattactgatagtttgttgcgtatttccgtgggtattgaagacagtgaagatttgattgctgatttggaccacgcgttccaattggcagtaacgaggtaagcatgaatgcaacagcggtagcagcggcggcaacgggccgtcaactgcataagtttggtggcagtagccttgcggatgtgaagtgttatctacgggtggctaatattatggccaactacagtcaccccggcgatctcatggtggtgtctgctgccgggagcacgacaaatcagttgatcagttggttgaaactcagtcaaaacgaccgtctttctgctcatcaggtacagcaaagtctgcgtcgttatcaacacgatctgatcaatggcttattgcctccagaaatggcagagccattaatcagtgagtttattcatgatttagagcgcctggcgggcttgctggataataaaattgatgatgtgatttatgctgaagtggttggtcatggtgaaatttggtcagcccgcttgatgtctgcgctactgaataagttggatatggatgccgtctggcttgacgcccgccgtttcctacgtgcagagcgtgcagcgcaaccacaaattgatgaaagccgctcttatccgttactgcaacaattaatggcccaacaccctcaccagcgtttggtggtgactggttttatctcgcgcaatgaggcgggtgaaacggtcttgcttggccgtaatggcagtgactattcggcgacgcaggtcggggcattggccggggccgagcgtgtcaccatctggagtgatgttgccggggtgtacagtgccgatccacgtaaagtgaaggacgcttgcctgctaccattattgcggttggatgaagccagtgaactggcccgcctggcagcaccggtgttacatacccgcacattacaaccggtttctggtagtgacatcgatttgcaattacgttgcagttatcagccggagcaggggtcaacccgtattgaacgtgtgctggcttcgggattgggtgccaagatagtgaccagccacgatgatgtttgcctgattgaattgcagattgccagtcaccatgatttctcgttggcgcagaaagagatcgatctactgctcaaacgtgcgcaaatcaaaccactggcgaccggtattcacccagatcgtaacctgctgcaactttgctatacctcagaagtggttaacagcgccttacgggtgttggaagatgccgctctgccggggaaactctctctgcgcgaagggctggcattggtcgcactggtgggggcgggtgtgagcaagaacccacttcacagtcaccgtttctaccaacaactgaaagatcagccagttgagtttgtctggcaggccgaagacggtatcagtatggtggccgtcctgcgtcttgggccgactgagcacctgattcaagggttgcaccagtcgttgttccgggcggaaaaacgtattggtctgatgctgtttggcaaaggcaacattggtgctcgctggttggagctgtttgcccgtgagcagaaaagtctttcggcccgcagtggttttgaatttgtgctagccggggtggtcgatagccgccgtagtctgctgagttacgatggtttggatgccagccggacgctggcattttacaacgatgaagccaaagaacaggatgaagaatccctgttcttgtggatgcgtgcccacccgtttgacgacctggtggtgttggatgtgaccgccagcccgtcacttgcagaacaatatctggattttgccagttatggtttccacgttatcagcgcgaacaaattagcgggggcttcaagcagcaataattaccgccaaatccgcgatgcgtttgcgaaaactggccgccactggttgtataacgccacggtaggcgcggggttaccggttaaccatacggtgcgcgatctgcgtgacagtggcgacagtattttagcgatcagcggtattttctctggcacgctgtcttggttattcctgcaatttgatggctcagtaccttttaccgagctggtagaccaagcctggcagcaaggtttgaccgagcctgatccaagggttgatctctctggtcaggatgtaatgcgtaagttggtgattttagcccgtgaagcgggttacgacatcgaaccgaatcaggtgcgggtggagtcgttggtgcctgctggcgcagagagtgggtcggttgatcaattctttgaaaacggcgaggcattaaatcagcaaatgattcagcgtttagaagccgcgaaggagatgggcttggtattacgctacgtggcacgctttgatgctaatggtaaagcgcgggtgggcgttgaagcggtacgtaccgatcatccgttggcttctttgctaccgtgcgataatgtttttgctattgagagccgctggtatcgcgataatccgttggtgattcgcggcccaggcgctggccgtgatgtgaccgctggggcgattcaatctgatttaaaccgcctatcacaactgttgtaatccgctgttattcgcctcttctgttctgcgcaggagaggcgcatcccccgttactcgccaatatgaatttttcacgcattgcgtgtgaatattaatcatcaccctaaacttatttaaacattgacactttagccaacttccgtcattttctatttagacgtctaaacgtatagacgctcataaataatgacaaataacatcagccgtcataatggcaatggagtaacagggtatgagtttttttcacgcaaaccagcgagaagcgctgaaccagagtctgtctgagctacaaggtcagattaatgtttcttttgagttcttcccgccgcgcaccagcgagatggaggataccctgtggagctcgattgatcgtcttagcacgttgaaacctaaatttgtttccgtgacctatggggcgaactcgggtgagcgtgaccgtactcacagcatcatcaaagggattaaggagcgcacaggcctggaagctgcgccgcatctgacctgtattgatgcttctccgactcagttgcgtgatatcgcgattgactactggaatagcggtatccgacatatcgttgccttacggggtgatttgccgccaaacagcggaaaacccgaaatgtatgcctgcgatttggtgggtttgctaaaagatgtgggtgattttgatatctccgtggcggcgtacccagaaattcatccagaagcgaaaagcgcccaagctgacttgatcaatctgaaacgtaagattgatgcaggtgctaaccgggccatcacccaatttttctttgacgttgagagttacctgcgttttcgtgaccgctgtgttgccaccgggattgacgttgagatcgtaccgggcattttgccggtttctaattttaagcagttacagcgttttgccaccatgaccaatgtgcgggtcccaaattggatgacatctatttttgacggtctggataatgacccagagacgcgcaaaatggtgggggcatcggtcgcgatggacatggtgaagatcctcagccgcgaaggggtgaaggatttccatttttatacgttgaaccgggctgagttgagttatgcgatttgtcatacccttggggtgaggccttagttttttaaaggggggaacggttttaatctcctggtggtttggtggtttggtggtttggtggtttggttctggtgatcgggttcggttgttatggctttacggctcacctggcctccgatgaaccaaccgccaatggggccataagcgtggcccccttggaaccccgcgctttcgcactatcgcttgcccactgcgtgggttccctcgattcatcatttcgctgacggaccgggccgattcgcttcctgctcaagcggccctcgctcggcatccatgcctcgcgtcctaccttcattcttcactcggctgctcaaatgtgctttggacgtcaacaacccattcaaaatcaaaaacgtattaaaagcctaaggatgatggtctggcttcactcgctgctcaaatgtgcttttaaggtcaaagaccaattcaaaatctaaagaagagggttttgaattgtttttttgacgttgagcgcaatcaggaatattgccgacaaggagagaggggcgagtgagcgggcatggacgccagcgaaaagcgcgcttgggcagggatgcccatcgcgctggctcgtcagcccgaaagacgcaggcggtttacccgcagggcaatatttcgcgcaagccgcaggtgcaggagggccggctagccctcctgctcggttgaggcgactgtaattaggtgatcactgaacgaatatcaaccgaaacctgatccggtctgctcttgagacgtaaagccataacaaccgaacccgcttaccggctcaaatcaccctcaccccaaaaataccaaaagataaccgggggaatctcttccccctaaatcctaaccggtattccgcatccccgcagccacaccggcaatggtcaccatcaacgcttgttcaacacaggcatcagggtgttcttgctggcgtgaacggtgcaacagctcggcttgcagtacgtttaatggatcggtgtacacgttacgcaacgcgatggattcggcaatccatggcaagtcagccatcaaatggtcatcgttggcgatagccaacaccactttaatatcggctgccagttggtcacgtaactgctgacctaacggccatagcgatttatccactaaacgctgatcataatattctgccagccacaaatcggctttggcgaagaccatctccagcataccaatgcgggtcgagaagaacggccagtcacggcacatggtggcgagtacatctcgcttacctgcatcgatcgctctctgcaaacccgcaccggcacccaaccaggcagggagcatcagacggttttgtgtccaggcgaaaatccatgggatcgcccgcagactttccactccaccgtccgggcggcgtttggctgggcgggaacccagaggcagcttgccaagttccaattccggtgtcgcagcacggaagtaacggacgaactctggattttcacgaacgtagctgcgatacatgtcgcaagaggcgtctgacagcagatccatcacttcaatccactctttcttcggctctggtggcggtaacagattggcttccagaattgcacctgcgtacagcgccaggctgctgatggtgacttccggtaacccaaacttaaagcgaatcatctcgccttgttcggtaacccgtaagccgcctttcagactgcccggaggctgagagagcaatgctgcatgggctggcgcaccaccacgaccaatagaacccccacggccatggaacaatgtcagcgtaatcccggctttctcacaggttttaatcagtgcatcctgcgcccggtattgtgcccaagaggccgccataacaccggcgtcttttgccgagtcagaatagccaatcatcaccatctgcttgccttggatcaggccacgataccaatcgatacccagcaactgggtcatgacatcgtcagcgttgttcaagtcatcgagggtctcgaatagcggggcgacaggtagagtaaatgggcaacccgcttctttcagtaacaaatgcacggccagcacgtctgacggcactttcgccatagagataacgtaagcagcgatagaaccttgcggtgcttcagcaatcacccgacaggtttccagcacttcttgtgtctcggcgctaggttcccattttagaggaaccagtgggcgcttagagttcagttcgcggaccaaaaaggcttgcttgtctgattcagaccaactctcataatcaccaaggcccagataacgggtcagctccgcgatagcatcggtatgacgggtactttcctgacgcacatcaatgcgcaccaatggcacaccaaaacaacgcacgcggcgtagggtatccaacaactgaccgttggcgatgatttccatgccacaggctttcagcgattgatagcaggcgtagagcggttcccacagttgatcattactgaccagtaaatcgtgtggtggcaatacgcgctcgcctttcagacgcgcttccagataagcctgggtattggtcaattgggtacgaacgttcttcatcagttggcgataaggttcaagcacctcttcaccaccggctaattcacgcagctccggggtacattccgacatagaaagttcagacaccagcacctgaatatcacgcaggaataaatcggtggctttccaacggctgagtagcagcacatggcgagtgatttcagccgttacattcgggttaccatcgcggtcaccgcccatccatgaagtaaagcgaataggtaccgcttccacgggtagacggtaatcaagggagttctctaactgctcgttaaactcacgcaggaatgcagggacgccttcccacaggctgttttccaccaccgcaaagccccatttggcttcatcaacgggcgagggacgcagtttgcgaatttcgtcggtatgccacgattgtgcaactaactgccgtaaacgacgcatgatcttgttgcgttcgtaatcggctaaatcattgtgatccaactggctcaggcaggtattcacttcaaccagtttatggatcaaggtgcggcgggtaatttcggttgggtgggcagtcaagaccaactcaatcgacaaatcgtcaaccgcgctgcgcatatcttgatcgctcagctttttatcttttaagcgggtaaataattgggcgagggcttccggattactcgcggcttcaccatgtggtgaaatactgtggtattgctctgccgtattcgtcagattaaggaattggctaaaggcacgggcgaccggcagtagctcatcgttggaaagattttgcagtgtggtcagtaattcctgacggctcgcttcattacccgcacgcgaagatttggataatttccggatggtttctactctatcaagaatatgctctcccaacgcttccttgatggtgtctccgagtagtgtgccgagcatactgacgttacttcgcattgcggaatattgttcgttcatatgacctctgacccatttatccttcgtgtttgaagccgcaggattgctagctatgttcactcacccgaatcacttacctgtcgttgaccttacttaaaatcgttgatcttacttaaataaacacatcgggattcattcacttgctgccgacctacaacgccaactacgttggatatacgatttctttttgtaaattagtttcaactaaaaggcagagatggacaattccactcgccacgttcaattccataccccaattgacactattttcagtaaaaaaacatcaattttagggatatttctgaaatttaattactgaggtgagattatcagtctggcttatcggcaatattgatcgtctaccccattatagttatttctgctggcaaaagtggtcaactagctgaccaatcagctcacgtgttggttcgataaaggccatatcaataaattcatctggctgatgtgcctgattaatcgaacctggccccagcactaatgtcgggcagacttgctgaataaaaggggcttcggtgcaatagttcaccaccgcagtgcgctcaccgagcagtttctcgatcacgccgaccatatgatggtctgttgggcactcatagccagggatcggagggtgcaactcatcaatactgagacgccccggccagcgttgactcaccggttccagcgcttcggtcattaactcatttaaatcacttaatgtcaggcccggtaacggacggatatccatatgtaattcacaacacgcacagatacggtttgccgcatcaccgccattaatatgaccaaaattcatggtgggataaggaatagtaaacgctggattgtgataacgctcttgcagtgtggtacgcagcgccatcaattgcgtaatagattcatgcatcaaatcaatagcattcaccccccgggccggatcactggagtgcccagactggccggtaatacgaatggcgttggagatatggcctttgtgcgcacggacaggttgcagtgaggttggctcgccgataatcgcgaagtcagggcgtagctgggtattcgcagcaaaataacgcgcacctgccatggtggtctcttcatcggcagttgccaaaatatagagcggtttggtcaacttgctggcatcaatatcgcgcaccgcatccagaataaaagcaaaaaagcctttcatatctgcggtacccaagccatagagtttatggtcatgctcggtcaaggtgaagggatcgcgggtccagcgcccttcatcgtaagggacagtatcggtatgacccgccagcaataacccgccatgaccttccccgttttcattttcgccaatgctggctaacaggttaaatttgtggcgagtatcaggcaccggctggatctcgacgcgaaaacccaggtctgcaaaccatccggctaacaaattgattaatgcctcattactttggtcgagggcactatcagcggcgctgatcgaaggcgttgcaattaacgcccggtacagctcaataaatggaggtaatttcatcttcactgttgacagcctttggttaggatagtatcaatattcatgcagtaattgtgaataaaaatacagtaagcttgagcgaaagggaacctaaactgacccttaaattcacgaaaatgtcaacgctcaatcatgtgggggaacagtaaaccttgctgagaacccgaataccagttttgactatttatgtttttatatgcataggcttttattgacataaataaaaatactcagaaggtgaactgaacccatgttaaatacgttgattgttggtgccagtggctatgccggcgcggagcttacggcttaccttaatcgtcacccacatatgaacataaccggtttagcggtttcagcgcaaagtgcagatgcaggaaaattactttccgaactgcatccgcagttaaaaggcatccttgatctcccgctacagcccttggtagatgtggctcaggcggctaaaggtatcgatgtggttttcctcgctaccgctcatgaggtcagccatgatttggcaccacaatttttagccgctggctgtgtggtatttgatctttccggtgcattccgtgtgcgtgatgcggcgttttacagccaatattacggttttgaacaccaacatcccgattggctcgataaggcggtttatggcctggcagaatggcaatcagaagacattaagcaagctcaattgattgctgttcctggttgttatccaaccgcatcacaactggcgcttaaaccgttggttgatgggcaattactgaacgatgcacagtggccagtcattaatgccgtcagtggtgtcagcggtgcagggcgtaaagccagcatgggcaacagcttctgtgaagttagcttgcagccatatggcctatttacccaccgtcaccagccagaaattgttgcccatcttggcacccccgtcatttttacaccgcatctggggaattttgcccgagggatcttggcgacgattacctgccgcctgaaagccggggtcacggcgcaaaacatcgccgatgcctatcaccatgcttatcagaataagccactggtgcggttgtatcaacaaggtgtcccggcgctgaaagccgtggtcggcctacctttctgtgatattggtttctcggtacaaggcgagcatttaattattgttgccaccgaagataacctgctgaaaggtgctgcggctcaggccgtacaatgtatgaatatccgttttggcttcccggaaacgcagtccctgttgtagcgttcggttgcaagcaatagattgtaagtgattgattgtaagtgattgattgtaattaatggattgcaagaaatagattgcagtaaacagattgtgagccataaattgtgagcaacagaaccggcagatacgcatattttatctgattatattttatccgattatattgaggcaaaagcatgatgaacccgttggtcattaaattaggtggcgtattgctggacagcgaagaagcactggaacgcctgtttactgcattggtgacctatcgtgagaaacatgagcgcccgcttgtgattatgcacggtggtggctgtctggtggacgaattgatgaaaagactcgccttgccagtagtgaagaagaacggcctgcgcgtcacccccgctgatcagattgatatcattactggcgcactggcgggtaccgcgaataaaacgctcttggcttgggcggtgaaacatcagatcaatgctgttggcttgtgcctggctgatggtaatactgtgacggttactctgctggatgctgaattgggccacgtgggtaaagcgcaaccgggttctgcggcactggtacaaactttgttggcggcaggttatatgccaatcatcagctcaattggtattactgttgaagggcaattgatgaatgtaaatgccgatcaagcggcaaccgcattagcagcaacgctcggtgctgatttaatcttattgtccgatgtcagtggcattctcgatggtaaagggcagcggattgctgaaatgacggcgcaaaaagcagagcaattaatcgctcagggcatcatcaccgatggtatggtcgtcaaagtgaatgcggcactggatgccgcgcgttcattaggtcgcccggttgatatcgccagttggcgtcattctgagcaactccccgcactgttcaacggtgtaccgattggtacgcgtatttcggtctaatattattgacgatgacgataaagttatacccaaagtcattggcgttacaggtaggcagccagcaaactcatccgtaagtaagtgattcgggtgagtgggcgcagctaacaaccctgtagcttcgaggacgaagggttttctattaagaatttagggaagcaagattatggcactatggggcggacggtttagtcaggcagcagatcagcgttttaagcaattcaatgattcactgcggtttgattaccggctggcagagcaggatattatcggttctgttgcctggtcgaaagcgctggttactgttggcgtattgaacgctgatgaacagcaacaacttgaacaggcgctgtcagttttactggaagaggtgcaggccaacccacacgctattttggccagtgacgctgaagatatccacagttgggtcgaaaccaaactgatcgataaagtgggtgatttaggcaaaaaattacacactgggcgcagccgtaatgatcaggtagcgaccgatctgaaattgtggtgtaagttccagataaccgaattacagacggcggtacaacaactgcaacaggcgttggtcatgaccgctgaagcgaatcaggatgcggtcatgcctggttatactcacttacagcgtgctcaacccgtgacgtttgcacattggtgtttggcctatgtagaaatgctgtcacgtgatgaaagccgtttacaagataccctgaaacgtctggatgttagcccattaggttgcggtgcgttggcgggcacggcgtatgctatcgatcgtgaacaactggcgggctggttgggctttgcttctgctactcgtaacagcctggacagcgtttctgaccgtgaccatgtgctggagctattatctgacgccagcattggtatggtacatttgtctcgctttgctgaagatttaattttcttcaacagcggtgaagcagcttttgtcgatttatcggatcgcgtgacatcgggttcctccctaatgccacagaagaaaaatccagatgcgctggagctcatccgtggtaaatgtggccgggtgcaaggtgcattaactgggatgacgatgacgctcaaaggcctgcctttggcttataacaaagatatgcaggaagacaaagaagggctgtttgatgcactgaatacctggcttgactgcctgcacatggcggcattggtactggatgggattcaggtaaaacgcccgcgttgtaaagaagcggctgaacagggctatgctaacgcgactgaactggctgattatttggtcgctaaaggcgtaccgttccgtgaagcgcaccatattgtgggtgaagcggtggtagaggcaatccgccagggcaaagctctggaggccttagcgctgagtgatttacagcaattcagttccgtaattggtgatgatgtgtacccgattctggcattgcagtcttgcttagataagcgagtggccaaaggcggcgtttcgccgcagcaggttgcatcggccattgccgaggctaaagcgcggctgttttaatttgctgggttttaatcttgagaacggggcgggccgctaattgcagcggcccgctttgcattaacagttattacccttaacagagctattatccttaacagctactgcccttaaaaacgactgcccttaataaccttatcttcattatctctatttttctcatcacgcctttttcgcctttatttttcttaaaatttcaatgttttcaatcttatgatcttttaaacttaatagactgttgagtttatattcctcagtgattatgataatcattatcaatagcggcgttgtgatgaggttcctgcaaaaattaaaaatttaaatatatttaatgaaaagtaaatgaccttcttactcgtaatgaaaaagcgttaacgcatcgtctaataaagaaacaaaattatcgtggaatgaatttaaattaagttattgattaactaaatccgtaacacacctcatacaaaaatgactatttattatttaccggcttcttttacttatcggcattagtgatatctaccgaccatgatgaatgcattactttgttgataattgatgttcatattatttttatattgttaaggatgaagtttcataaatggataatataattagagataaaaaaacaataatttcagtgaataaaattacaacttgtatattattcgcattggtaacgcaaagctattcagggcagctagcggcaaatacagccacaatccccactaataataacgatatggcgttggataaattaaacgtcgaaggtaaagggaatgcccatgatagcgattggatatatgacgaaccccgctcggtcagtgaaattacgcgggaacaacttgataaccggcccgctcgccacgctgcagatattttagaacaaactcccggtgtctattccagcgttagccaacaagaccctgggctttcaataaatattcgcggcatacaagattatggccgtgtaaatatgaatattgacggtatgcgtcagaactttatgaaaagcggtcatggtcagcgcaatgggtcgatgtatattgacccagaaattttaagcaatgtggtgattgaacggggcattttcaacggtattggtggggcgggagccattggcggtatcgccacctttaataccatcaatgccagtgattttttggccccagagaaagagctgggcgggcatatccgggcaatgaccggggataacggcacccgctttattggcagcggtgcgttggcgctgggcaacccaaatggcgatatattacttgctgttagtgaacgtaacctgaaggattattggccggggaataaaggcgttttggccgggttgcgtctctatagccctaccagaaacgtcggcgatgacttaaagaataccaagacattgtttacaggctataaaatgcgttcgcagctcgctaaagtcggttggaattttgaggccggccagcgtttggagttcagctatttacaaacacaaatcgccagccccaatgccagtatgctgtcagaagttctggcattgtcgccatcagggaaagagataacaaagattggctggaggaacacaagttttactaacgtggaaaaccgtaatattgcgttagattaccgcctgaatcctgagcatattagttggctggatgcaacggcaaagatctattacgttgataccaatgatgaaactgataatgctaattcccttttcaaggaatatttctggactcaaacacgcctgaaaacccgtggcttacaattgcaaaacaccaatacctttaccccatcggatgcgcatcaaatacggttgaaatatggtttggaatggtttagcgataaatctgaggggtactcaacacgcaaacttattgaaagaacgaccccccccggcaagcgcgctatcaccagtacctttgctcaacttaactacgaatatgatgattggctgcggttggaaggagggctgcgttatgatcaattccgtttgaaaggcaatacctggctccatacccgctctttcctgcagccctatacttttgagaacccctgtgaccgaaggatacatgagcagtctgaaaagcctggatcgcggtgttcatctaggagacccgcaacaatgaggtgggatgttgaccgccgtgaacagcaactctcgccaacgttggcgatgggggtcaagcctggcctcgaatggctggagttttttggcagctacggtaaatcctggcggccaccggcaatgacagaagtgttagcaaccggcaccgcccatggttacagttgggtcttacctaatcctttcgtggccgccgaacgtgccagaacgtgggaggcggggtttaatattcagcagtccaatttatttatcgaagacgatcactttgccgcgaaggtcgcttattttgatacccgtattgccaactatattaaccttgaattaggtaaggccaaacccaagtttgggggggattcttttactgatgtagcttatgtcaataatttactcaaaacccgtttccgtggcttagaatatcaattaagttatgatgctggcacattttataccaatattaattacaccagaatgattggtgtaaataatgtttgttcaccatatgcttggttaggcggcttacagtcagtaaaatataagtacgttggaaaggtagagcaaatttatgccgttgaaaatgaggtggccaataattatgtaacctgtatgaatgccaatgtgttatttggctcatcggcttatttaccgggtgatcgcggtagtttaactttggggagtagaatatttgatagaaggctagattttggtactgttatccgttataacaaagggtatcaggatcgttcagcgcaagatgaaaatggtaatccactgacggcttatgttgccgattggccgaagtatatcgtatatgatctttatgccagttataaggtaacgaataatttaatattgcgtagttcaatagaaaatataactaaccgtgcatatttagttaattatggcgatacgctttcatttgcccctagccgcggcaggactattcagggtggttttgaatataaattctaaattataaagtctttaggtgagtatactctaaataattcgagttgcagaaaggcagcaagtgaataaatcccgcatcattgacggcagtcaatgatgcgggtgagagaacacagctaacacatatgcaacttgaagtatacgagaataatatatttcacttatggaaccacatggattaataataatccatgttcaccgtaacaattaataattaaaaggacattatcatgagtacaactattcaatataacagtaattatgccgattacagcatctcctcttatcttcgggaatgggctaataactttggtgatattgatcaagctccagctgaaacaaaagatcgtgggagtttctctggttcctcaaccttatttagcggtactcaatatgcgattggtagctcgcatagtaatccagagggaatgattgctgagggtgatttgaaatactcctttatgcctcagcatactttccatgggcaaatagacaccctgcagtttggtaaggatttagctactaatgcgggtggccctagtgcaggtaaacatcttgaaaaaattgatataacctttaacgaactggatcttagcggtgaatttgattctggtaaatcaatgacagaaaaccaccaaggcgatatgcataaatccgtacgtggtttgatgaaaggtaacccagatccaatgctggaagtgatgaaagccaaaggcattaatgtcgatactgcctttaaagacctgtctattgccagccaatatcctgacagtggttatatgtctgatgcgccaatggtggataccgttggtgtgatggatagcaacgatatgctgctagccgcttaagaaaaacagccagaaaataactttctggctgagtcattgataccaccgctagggcttactggccggtttgctgtagcggtggtgcagattgtagttgtcctaagaaatcaaagtcaataacgctacctttaacggcaatagccctctcgtgtggaaatggacgccatggaatcttgcaaaacgcccggagcttcatcggtaccgccaacaattctgtcggttctggcgggtaataaaaaaatcctctggggcatcgggctatttactgccgtaataaacttgctgatgttggcaccggccatttatatgctgcaagtgtatgatcgcgtcctcgcctcagcgaataccatgacattattgatgctcactgttctggtgctgggcgtatttgtttttattggtttattagaatgggttcgcagtgcagtagtgattcgcttggggactcagattgatatgcaactcaatcagccggtctttaacgcggcctttgccgccaatcttaagggacataacacgccagccgcgcaagcgctaaatgacctgacagtgttacgccagtttgccaccggtaatgcgttatttgccttttttgatgcaccttggttcccgctttatttgctggtaatttttttgcttcatccgtggctggggatgctggccgccgcaggcgcaggtatattggttgttctcgcttggctcaatcagtggatctgtaaaaaaccattacacgatgcctcaattatcacctcacacgcgacacaacaagccaatgctaatttacgtaatgcggatgtcattgaagctatggggatgctcaaagcattacgtgaacgttggttaatgcagcacgcgaattttctctaccaacaaaatcttgccagcgataaaagtagccgggtgacggcggtcgctaaatcaagccgccaggcattgcaatcgatgatgttaggtctgggagcgttactggtgatttataatgaaatcacggctggcgtgatgattgccgggtcaattttaatcgggcgggtgctggggcctatcgatcaacttattgcggtctggaaacaatggagccacgcccggctggcttatcaacgtctctcccaattactggcgcagcatccatcatcacccaccggcatggttttgcctgccccacaggggaaactaaacgttacgcaacttatggcctgcaagccgggcacgcacattccagtattacactccatcaactttgaactgcaacccggtgatgtactaggtattttggggccatcaggcagtggtaaatccacgctggcaaaactcttggtcgccagccagcccgcattcagcggaacagtgcgtttagatagcgcagacctttctcgttgggataaaacgcagttaggggagtttatcggttacttgccacaaaatattcagctattccgcggcactgttgctgaaaatattgcacgttttggcgctattgataccgcaaaagtggtcgcagctgcacagttggcagatgtacacgatttaattctgcatttaccgcaagggtatgacaccccgttaggtgacgacggcgaggggttatccggtggtcaacgtcaacgtatcgccttagctcgggcaatgtacggaatacctcggcttatcgtattggatgaacccaatgccagtttggataaagaaggggagcaagccttattagccagtattatccagctaaaacaacaaggttgcaccatcgtgatgatcacccataaaccagagctgttatctggcagtgactatttgctgtttttaaagaatgggcaaatggatctatttgatcgtactcaggcggtcttacagaacattcagggtaaggataagcctgccgtgcaacctgaagcgaaaatacggaatagccgaagcggttggagcaacggtgtgtcatatggcatcgggccggctcgtactacatcatcaccgaagccatgatcaccaaaacccttatcacaaaaaacctcatcacaaaaactgtgaccataaaaaccagggatggagatataaccgatgttgcctgaatcagcctgttattcggttgcgaatgccaatcgccaaccaccactccaaataaacagtgggcgctatctcaatataggtggggggctggtcgttatcggcttcatcggctttttactttgggcggggttagcgccgttagataaaggcgttgccgtgaccgggctgcttgtggtggcagaaaaccgcaaagtgatccagccgctgcaaggggggcgtattcagcaactgcatgtcactgaaggcgacgaaatagtgtctgggcaattattggtcacgctggatgacacggcgatacgcaatcagcgggataatttacagcatcagtatctaagcgcccttgctcaggaagcacgtttgactgctgagcaaaacgatctggatgtgatcactttcccgcaggcgctgcttgagcacgcaacacaaccagcggttgaacgtaatattattttgcagcaacaacttttacatcaccgccgccaggcgcacttgagtgaaatcgcccggttatcgacacagctcactcgccatcaggctcggctcgatgggttgcaagctatgcggagcaatcatcaacgtcaatccaatttattccagcaacaattagacagtgtgcagttattggcaaaggacggttatattgccaaaaataaattgttagaaatggaaagccagttaacctcactccaggcacgagtagaacaaggtaccagcgatattgcggaagcacataagcttatcgatgaaacagaacaacatgttttacaacggcgcgaacaatatcaaagtgagaatagcgagcaattagccaaggcacagcaaaacacccaagaattggtccaacgtttaaatattgcagaatatgaattgagtcatacccgtatttttgcaccagtcagtggttcagttatcgcgttggctcaacacactgtgggtggcgtagtgagctcagggcaggcattaatggaaattgtccccattgggcagccgttattcgttgaagctcagttaccggtagagctaattgataaggttgcggtcgggctacctgtagatctcaatttttctgcgtttaatcaaagtaataccccccggctacaaggctctgtatggcgcatcggagccgatcgtatacaacccccacctacttcaccgccttattaccctttaaccgttgcgattgatcttgacccgacggaactggcaatccgtccaggtatggccgttgatgtttttatccgtaccggagaaaggtcattactcagctatttatttaagccattcactgatcgtctgcacctcgcgttagccgaggaataaaatatctcggttaagtcattggaaataaaacattaaaaataaaggaatataatgatttcttatcatgaatagattacagcagagcagtgaaaaacttatattttggctagtcggggccttattagcgtgtggtatccatatttatgcactttggtggctgagtaccgcatctataccagcaatacccaccagctaccccgccgcaataatgatggagctttcagccgaaccggaatttatgcaaaacttgccacaaaactcagtggtgggcataacgcagaatattatcgagcctgcggttgagcaacggatcaaccagccggatgacattgtcgatttacctacgctgcctgaacaaccagaggggcaacgggagattacgagaaaagagccaataaaggtcaaacggccagctgaaaatagagcgacatcgcgtaaaccggttaataaagaaacacaagaaagtgacagcaaacaatcctcaccagccgctgcagccagtgcaatgctttcagggacgagccaacaagttgccgcagcggtaaacagtgactcatcccaccgtcagcaagctcaagtgagttggaaaagtcgtttacaggggcatttaatggggtttaagcgttacccatccagtgccagaaaacagcaacagcaagggactgccatgattcgatttgtagtcgataaaaatggttatgtgtcatcagtgcaactgagtaacagtagtggtacatccgctttagatcgcgaggcgttagcgattatcaagcgcgctcagccattaccgaaaccgcctgctgagttgttatcgcaggggcagataacattatctctgcccgttgattttaatctaaaaaggaaataatacgggcaatcgcagtgggtaacatatgagtagagcgcaaaatacgcaaaataagagaggggagaacgggggattaaaaaccgggcgtcgtgcccggtttgaaccgcctgaggccttattcaccagggcagcgtaggcagcgctccgcttcatcagcgcccagctttaatttagattgcaaatcacgcaatgcggtacgcaggccttcttcaatgaccggatgataaaacggcatatcgagcatctggtcgatggtcatttgttgctgatgcgcccatgccagtaagtgggcgatgtgttccgcacttggccccatcatctctgcccctaagaatcggccagtgccctgttcgccataaatgcgtaaaatgcctttgttttttagcatcacccgcgagcgaccttgattctcaaaggagacttcgccaatctcaaagcaaccacaagcgctgaatttttgtgctagctcacggaaggttgcccccaccatggcaatttgtgggtcagagaacacgactgaaattgggctacggcgtaaaccgggtacaacctcagggaatcctcccgcatttacaccggcaatacgtgcctgatcgctggcttcatgcagtaatggcaactgattgctggcatcacctgcaataaaaatatgcggcacgttggtttgcatggtcaggcggtctgcctgcggcactccgcgttcatccagaatgagtgacgtattctccagccccaatttatctacattagggcggcggcccgtggcggctaagacgtagtccaccataatctcctgtggcctaccgcttttatccagataacggataaagactttatctccctcacgttgcatcagctcaacttttacatcgggatcaagatagaactcatcacccaacgtttttgctgcgtagtcacgcacgatactgtcggtcagcgggccaacggcaccaccgacaccaaacatttttacctggacacctaaccggtgcagtgcctgaccaagttctaagccaataacgcctgggccaaaaactgccacagattctggcagatcgtcccaattaaagacgtcatcattaataatcaaccggtcacctagctcattccaagaggcgggccagcttgggtgggaacctgtcgcaatcacgatccgctgcgcaatgattttttgtgaagtaagctgcgtgtgatcatcaacttgcagggtgttatcatcaataaaacgggcataaccttgaattttatcggccgcaggaatggtctctacgcctttcaatacgaagcccacaaaacggtcacgttcacgcttaacgcggtccatgacttcacggccattaatcaggggcttaccttgtgggtgaataccaaatccgggcgctttttctatctggtggacggcttcagccgccgcaatcaatagtttggatggcatgcagccgacgcgtgcgcaggtggtaccatattcaccaccttcaatcatcactacgttgggggtcaacagtttggccgcgcgataagcgcccagtccggccgttccgccgccaataacagcgacatcaacgtttaaggttttcatgtctactcctaacagaaaaaaaggtaggccggagcctaccaagttacttcctattgctttaatttttattaatatgtttgttaatcaacataattaggctggtaggtacttttccagatcgtcgctgccaccaatgtgacggcctccgataaagatctgtggcaccgtggagcggccgcttacagcacgcaagctgacggtcgttgcatctttacccaatacaatttcttcatattgaaggccatgatcttgcagcatttgtttcgctttggcacagaatgggcagcccggtttggtaaagacagctacggattcctgcactttaaaatcaggtgccagatatttcaacatggtgtcggcatcagatacttcaaacgggtcgcccggtttgtttggctcgacaaacattttttctaccacgccattacgtaccagcatggagtaacgccatgaacgtggaccgaagcccagatctgctttctcaaccaacatattcatccctttggtaaactcaccgttaccatctggaacaaatgtaatattttcagcgtgttgatctgatttccaagcgttcattacgaaggtatcattgaccgacacacacagaatgctatcaacaccgtgttgtttaaatacacccgctaattcgttataacgtggcagatgactggaagaacaggttggggtaaaggcacccggtagtgaaaatacaatcacggttttattactgaataaatcgtcggttgttacgtcaatccactggtcgccctgacgggtatggaaagttacctgcgggacttttttaccttcttggctagtaaacatctgtaattccttaattaaaaaatagaaaagttagatttttttgggtgtctctttgttgggtcatattattaattttatctcttgatagttctaatcactggttgctatcttatctatcgtcagtagctatcataaggtgggcatagatgaatattcgtgatctagagtacttagtggcgttggctgaatttaggcacttccggcgtgccgccgactcctgtcatgtcagccaacccacattaagcggtcagattcgtaaactggaagatgagttggggatcatgttgttggagcgaactagtcgtaaggtgttgtttacacaggctggtttactgttggtggagcaggcgaaaacggtattacgggaagtgaaagtactgaaagagatggccagtttacagggtgaaagtatgtctgggccgttgcatattgggcttattcctaccgttgggccttatctgttaccacaaattattcctatgctgcataaaacattccccaaattggaaatgtatctgcatgaagcccagacccaaaatctcttagcccagttggatagtggtaaattggattgtgccattttagccctggtcaaagagaccgaagcttttatcgaaattccgttatttgacgagccgatgaatctagccatttatgccgatcatccgtgggcgaaccgcgaaagagtggagatgcatgaattggcgggagagaagttactgatgctggaagatggtcattgtttacgtgatcaggcgatgggcttttgcttccaggctggagcggatgaagatactcacttccgggcgactagcttggaaaccctgcgcaacatggtcgcagcgggtagtggtattacgctgttgccagcactggctgtgccgaatgaaagacagcgcgatggtgtatgttatctggagtgctacaaacctgtccctaaacgcaccattgcgttggtgtatcgccccggttctccattgcgtggccgctatgaacaacttgccgaggcaatacgtgatcacatgcaagagcgcatggcctcatcattagaacaggcgatttaagccattgagtgcggccacacggtaggcttctgccatggttgggtagttgaaggtagtattaacgaaatactcgagcgtattgccttctcctttctgttccatgatagcttgcccgatgtggataatttcagcagcacgttcaccaaagcaatgaatacccaaaatttgcttcgtttcccgatggaacaggattttcaaactaccggtatccatcccaacaatttgcgcccgcgccagatgtttaaattgcgcccggcccacttcgtagggcactttcatcgccgtcagctcttgttcggttttcccgacagaactgatttcaggaatggtgtaaatgcccgtcgggatatcttcaatcaggtgaacgttggcttcacctttgatcatggcttgtgcagcaatacgcccctgatcataagccgcagatgccagacttgggtaaccaatcacatcaccgacagcatagacatgagacagcgcggtttggtacatgctgttcactttcagcaaaccacggctatcggcttccaggccaatattttccaagcctaaaccgctggtattacctgttcgtccattagcatataacaagcagtccgctttgacctttttgcctgatttcaaatggacaatcacgccgtccgttgtcccttcaatctgctcaaattcttcgttatggcggataaccacgccgttattccagaagtgataagagagcgcatctgacatttcctgatcaaggaaagccagtaggcggtcacgggtattgatcaaatcgactttgacactcaacccacggaagatagacgcatattcgcaaccaatcacccctgcaccataaataatgacgtgctgtggctcatggctgagctgcaaaatggtatcgctgtcataaatgcgttcatggttaaaatcaacattgactgggcgataagggcgcgagccagttgcaatgacaatgttatcggcctgcaaggtatcactggtaccgtcggcgtaacgcacattaaccgtattggcatcaatgaagctggcatcacctgagaacatgtggcaatggttgcgatcataaaagccttgccgcatacgggtttgctgattaataacacgatctgcatggtttaaaatatcagcgaaagaggattttatggttctggcattgtcgctgtagagggggttttggttgaactcgataatacggctaacggcgtggcgcaaggctttagaaggaatggtaccccaatgggtacatccgccacccacattattataccgttcaatcacggcaacgcgtgccccttgcttgaccagccccatcgcggcaccttcaccgccagggcccgagccaatcacaatggcatcaaaatggaagtgctgttgcatgtaggagagacctgtttttatacaaaattacaacgatacattaacatcatcttaggcagaacccaatcaacgataggggaatcaccataatgtgtgttgtaaagtcgcaattcggtattgagaagatacgtttgtataacggttgttaccgcaaagtttggtatattgctgactatatgtcttagattgagaaattggatatcccttgggtacgattatgggcgtcagagcacaacaaaaagagcggactcgtcgttcccttatcgaagcggcgttcagtcaactgagtgctgagcggagctttgccagcctgagcttacgggaagtctcccgtgaagcaggtatcgcaccgacttctttttaccggcatttccgggatgtcgacgagcttgggctaaccatggttgacgaaagcggcctgatgttacgtcaattaatgcgtcaggcacggcaacggattgccaaaggcggcagcgttatccgtacatcggtgtccacctttatggagtttatcggcaacaaccctaatgcgtttcgtttgctgctcagggaacgttccgggacttccgccgcttttcgtgctgcggttgcgcgtgaaattcagcactttattgctgaactggcagattacctcgagttagaaaatcacatgccacgtagcttcactgaggctcaagccgaggccatggtcacaattgtcttcagtgcaggtgcagaagtactggacgtggatattgaacagcggcgacagttagaagaacgcttggtcttacagttacggatgatctccaaaggtgcttactattggtatcgccgtgaacaagaaaagcttgctgcgtcccgtgtagaataaggtaaagaaaatatggaacaatcttctcgccgtgaaaccggcaccctactactggcattaattactggcttggcgataaatggggtatgtgccgcgttattcagtgcgctggtgcctttttcagtttttccactactgacgctcatactggcggtgtattgcctacatcagcgttatctcaattttgctatgccgcaagggataccggtgctggcttcagcatgtttcctgcttgggatcttgttgtacagcgcgattgtgcgggtggaataccctgcaattgggtctaacttcgttcctgcggtgctcagtgtggtgttggtgttctggatcttatttaaattaagaacacgtaaatcggtacaaacacatacagatgcggatattgatatcaataactcggatcaaccacagcaatagcccttgggtcttcagccctatcaagctgttttatagcgcggtgctcgaaggggttactgcacctagataccgtcttgccaactaagggcaacatgtcgttgccctttcttttatctgcggtatgaattattcgtcagtgacgtttttccagcagtaccccacattccatatggtgggtataagggaattgatcgaacagtgctagtcggctaattttatgtgtgtgctgtaattgttccaaattggcgcacagcgtctctggattacaggagatataaagaatacgcgggtaagcctgtactagcttaaccgtctcgtgatccagcccactgcgtggcggatcgacaaagatggtctcgcaattataactgcccaaatcaatacccttcaggcggttaaactcacgaacgccctgcatcgcctgagtaaactcttccgctgacatccggataatctgcacgttatcgatattatttgctgcaatattatattgagccgctgcgacggaaggtttggcaatttctgttgccagcacccgttcaaaatttcgcgccagtgccaatgagaaattaccgttaccacaatacaactccagtaaatcgccagtggcaccttgggtaacatccagcgcccattccaacatgtgaatattcaccgccgcattaggttgggtaaaactattttcaacctgccgatagatcatctcgcgtccggcgactggcaagacctcatcgatataatcgtgatccagcatgattttagttttagctgctcgaccaatgagttgtaggtcaaaaccttgtgcacgtaactgatctcgcagttccagcgctttttgctgccactcttcatctaattggcggtgatacagcaacgaggcgatcagcttaccgctgagggtagataaataatctatttggaacagtttgcgtcgcaatagcggctccgctctgatggcggtcatcagagcatccattaagcgattgattaaccgactggctaccgggaattgttcaacccggatacgttgcttggtctgttggtcaaacatgatgtggtacaagtcatcttcatcatgccaaacgcgaaactcggctctcatacggtaatggtctgccggagaacgaaatatttctggctcgggtgcctgaaatggcaacatcatcgccttaagacgggcagacttttctgccagttggtggtcgtagctttcaatcggcaggatgttgggagtcatgtttttctcgttgggtcagtataaaagggggatgatccttgcggattgtagggaaagttgccctgatgtccagttttgtcgtgtttattccggcgtggatcaatggaagtctagacatctattttacttgatcgtagcattgtggtccggcctcatgctgttatttaaacacctaagagttaaaagggaatccggtgtaaatccggagctgacgcgcagcggtaaggggaagtcacggcgataggtttctaacagacactgtccgcaaggatgggaagtcatcgcctgttctatttcgtgccatttatttatgacagtatttttactgtcataaccatggcctgataccagagatcctaagcccgaagacctgccggtattacgtcgcaatattcgtggccgtcgcgtactaccggccatggcactgcggcatccgccaattgagtttggatgctctcttaatgataattaaaaatacaatgacaattaaaaaatatacgctgctcacagccctttctgtgacggcattttctggctgggcgcagggtaataacaccacggacaacaataatgaaatggttgtaacagccaaccgttttccacaaccgaaaagtagtgtattagcgcctgtcgatgtagtcactcgtgccgatattgatcgctggcaatctacaaatataaatgatgtcttacgccgcttaccgggtatcaatattgcccaatatggtgggccaagacagctgagctcgctatttatccgggggaccaattctagccatgtcttggttctggtcgatggtgttcgccttaatcaggccggtatcagtggttcttcagacctaagccaaatccctatctcattagtgcaacgtatcgagtatatccgcgggccacgttcagctgtgtatggttctgatgctattgggggggtagtaaacattatcactgagcgtgaaacgttgggaagtaccctcacggcagggttaggttcgaacggttatcaaaattacaatggctcaacgcagcaaaaactgggtgacgacacaacaatcactttggctggcaattacgattacagcaaaggttatgatgtggttgccaagggaaatactggcatggccagtcagccagatcgtgacggttatctcgggaaaatgttgtggctgggcgctaaccacaaatttaatgagcaattcagcggttttgtccgtggctatggttttgataatcgtagtgactacgacagttattattatccgggtagccctctggtagatacacgatcactatctagccgaacatatgatactggaataaatttcagtaatggcggttatgcttctcaactgattggcagttacagtcgaactcaagactataattatgatcctagctatggtcgctatgatcaatcagccactttggatgatatttcccaatacaatcttcagtggaccaatacctatcaacttggcttaggtaatgtaggcggcggccttgattggcagaaacaaactactgagccaggtactaattacttatccaatggttatgaacagcgaaataccggtgtttacggtaccgtacagcaatttgtcgggccagtaacattggaaggtgctattcgtggtgatgacaactcgcagtttggctggcacaccacttggcaaagtagtgctggttgggagtttgttgatggctatcgtttaatcggttcttatggtactgcatttaaggcaccaaatttggggcagatatacagttcaacttacggtaatcgggatcttaagccagaggaaagtacccaatgggaagccgcaattacggggatcacgggaccacttgattggcgtttatcggcttatcgtaatgatattgatcagatgattgcgaccagaggggtatatccaaactcccgctattataatgtggagaaagccacgattaaaggtgttgaatggacaggttcgtttgagactgggccgttatcacatcaagtgacgctggaatatctggacccacgtaatgcagatacccacgagattctggcgcgccgggccaaacaacaagttaaatatcagttggattggcagatggctgatttggattggtccgttacctaccaatatattggccagcgttatgacagtgttttcgatccaataacttatgcggcaagcccggtaaagttagctggaattagcctctgggatctcgctgtttcgtatccggtcacatctcatctcacggttcgtggtagaattgccaacctgtttgataaagattatgagatggtttatggctaccaaaccccaggacgcgaatactacttcacgggaagctataacttctaaggctgactctcctcctcgcccgacagcactgatttttgattcgggtgttggcgggctgtctgtctatcaagagattcggcaactgttgccgaatctccactatatatatgcttttgataacgtcgctttcccttatggggaaaagtccggcgaatttattgtcgagcgtgtgctggaaattgtgaccgctgtacagcagagtcaccctttggcaattgttgtcatcgcgtgtaacacggctagcactgtctctctgcctgcgttacgtgaacgcttcgccttccctgttgtcggcgtggtcccagcgattaaaccggcagtaaggttaacgcgtaatggcgttgtgggtttacttgccactcgtgcaaccgtccatgcttcttataccttagatttaattgcgcgttttgccactgattgcaaaatagagttgctgggttcatctgagctggtggaggtagcagaaaccaagttgcatggtggagttgtaccgctcgaggtattaaagaagattctccacccatggttaagcatgcgtgagccaccggatactatagtattgggttgcacccatttccctctattaacagaagagttagcgcaagtgctaccggaaggtacccggatggtcgattcaggcgctgccattgctcgccgaacggcttggcttatctcttctcaagagaatgttatttcttctcaagatgaaaacatcgcttactgcatggctttagacgaggatactgacgctttattacccgttttacagagttatggtttcccgaagctgcaaaaactaccaatttaagcgcaattcgtctaaagaatcagcggttgaaaagttttttgaaattaggggttgcaggctgtcaggaactccctataatgcgcctccactgaccgggaacaacgaaacacacttcgccgggtcaggaagagaaaagcagacttgaacttcgaaagaaataaaagaaaaccttgactcttcagcgggaaagcgtattatctgcctcccgcgttaccgtaagattcgccgcaaggcaaacgggtaacgaacgctctttaacaatttatcagacaatctgtgtgggcactcgcaagacgatatcgacgcctgtttcggcaggcagaaataatatcaagtcttgaagagtgaccaaagcagtaaacattttgacttcggtcagaatgcatatttgcagaaagtaatctttgagcaccgctgcttttacgcaagtaaaagtcagcaaatcaaacaaatcttaaattgaagagtttgatcatggctcagattgaacgctggcggcaggcctaacacatgcaagtcgagcggcagcgggaagtagtttactactttgccggcgagcggcggacgggtgagtaatgtctggggatctgcctgatggagggggataactactggaaacggtggctaataccgcatgacctcgcaagagcaaagtgggggaccttagggcctcacgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggttgagtttaatacgctcaatcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaatttggcagagatgctaaagtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagccagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaacgatacgcattgcgcagtgcccacacagattgtctgatgaatgtaaacgagcaagagcacctgttgatgttatgagtttcgactcatgctgatacgaaacggttgaatttcggtttgatcggcattttcgtgtccccatcgtctagaggcctaggacactgccctttcacggctgtaacaggggttcgaatccccttggggacgccaatccgataatgagtgaaagacattatcaccggttctttatgaactgaaaaataacgtaaagatgactttaccaagtcgtgtttacgatattgctctttaacaatctggaacaagctgaaaattgaaacattacagctgaaatttaccccgccgtagatgtattggggtaaagagtaacctgtaatagagtctctcaaataatcgcaacacaagatgtactgtcagcaatgacaagacaccttcgggttgtgaggttaagcgactaagcgtacacggtggatgcctaggcagtcagaggcgatgaagggcgtgctaatctgcgaaaagcgtcggtaagctgatatgaagcgttataaccgacgatacccgaatggggaaacccagtgcaatacgttgcactatcgttagatgaatacatagtctaacgaggcgaaccgggggaactgaaacatctaagtaccccgaggaaaagaaatcaaccgagattcccccagtagcggcgagcgaacggggaggagcccagagtctgaatcagtttgtgtgttagtggaagcgtctggaaagtcgcacggtacagggtgatagtcccgtacaccaaaatgcacaggctgtgaactcgatgagtagggcgggacacgtgacatcctgtctgaatatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagcaccttcgtggtgtgactgcgtaccttttgtataatgggtcagcgacttatattttgtagcaaggttaaccgaataggggagccgtagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatcttcgggggtagagcactgtttcggctagggggccatcccggcttaccaaaccgatgcaaactccgaataccgaagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacacttaggtgttgttgggtaggggagcgttctgtaagccgttgaaggtgacctgtgagggttgctggaggtatcagaagtgcgaatgctgacataagtaacgataatgcgggtgaaaaacccgcacgccggaagaccaagggttcctgtccaacgttaatcggggcagggtgagtcgacccctaaggcgaggctgaaaagcgtagtcgatgggaaacaggttaatattcctgtacttggtgttactgcgaaggggggacggagaaggctaggctggccgggcgacggttgtcccggtttaagcgtgtagggggagtgaccaggtaaatccggttgcttatcaaccctgaggcgtgatgacgatgcactacggtgcagaagcagttgatgccatgcttccaggaaaagcctctaagcatcaggtaacattaaatcgtaccccaaaccgacacaggtggtcaggtagagaatactcaggcgcttgagagaactcgggtgaaggaactaggcaaaatggtgccgtaacttcgggagaaggcacgctggcgttaggtgaaaggactagctcctggagctgaagccagtcgcagataccagctggctgcaactgtttaataaaaacacagcactgtgcaaacacgaaagtggacgtatacggtgtgacgcctgcccggtgctggaaggttaattgatggggtcagccgcaaggcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggccttgaagtgtggacgccagtctgcatggagccaaccttgaaataccaccctttaatgtttgatgttctaactcggccccataatctggggtgaggacagtgtctggtgggtagtttgactggggcggtctcctcccaaagagtaacggaggagcacgaaggttagctaatcacggtcggacatcgtgaggttagtgcaaaggcataagctagcttgactgcgagagtgacggctcgagcaggtacgaaagtaggtcttagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggaagattgagaggggctgctcctagtacgagaggaccggagtggacgaatcactggtgttcgggttgtcatgccaatggcattgcccggtagctaaattcggaagagataaccgctgaaagcatctaagcgggaaacttgcctcgagatgagtcttccctggggcttaaagccccctgaaggaacgttaaagactatgacgttgataggctgggtgtgtaagtgcagcgatgtattgagctaaccagtactaatgatccgtgaggcttaaccttacaacaccgaaggtgttttgaattgagagagattttcagcgtcgttccgagattggattgactggcgtcacaagcgttgtttgtgtgcgggttaattaaaacagaatttgcctggcggccatagcgcggtggtcccacctgatcccatgccgaactcagaagtgaaacgccgtagcgccgatggtagtgtggggtctccccatgcgagagtaggacactgccaggcatcaaacacgagttatcagagtgacatctggtaactgtcaaaatcgccaaaagcggttttgcacagcgcagagcgctggcccttatagggtaaagtatcgggaagatacacgtaaaagaatcggtggagcggtagttcagttggttagaatacctgcctgtcacgcagggggtcgcgggttcgagccccgtccgttccgccaccctaattaggggcgtagttcaattggtagagcaccggtctccaaaaccgggtgttgggagttcgagtctctccgcccctgccagataaaaaacccttcgcgaaagcgaggggttttttattttaagtctgtaaaaaattaataccctttcctcattggcttaatgccttttccttttccttcgctttctctttcctcattataatttaatgatttttataatattttggttatctcaaatatcacctcagtagcacacagattcagtccaatatacatgcccagatattggtatgtgcgcaagtcagcagacgcgtcgtaaacttgcgctataagccctatatagggcttcctagagcttgattcggggggggcttcgggtattgtggcataggctatttcgatgcaagaaagccctctgttcacgtaataggccactccattgtatttcttatgtcacatatcatacatggcttctgatacgttcagttttctggacattcttgctattggttcgctcagttaaggcggttttaggacccaggtattctgtctctttggcaagaattatgacttttcatcggtacaaccgcctttactaaccgggttgcagtatgttggtattccagttcgggagcgggtaggttgttggtgttatatcggggcgatgatattcacattttcattttatttactgataaaaatgatgccttccaacgtttataacttctctcattaatcatctttttttgttgatttcttatatatctgtaaatggtaacgttcccgacatatgtctatttggctgaatctatgtacgaaatgattgttattctgtggtgtgacgccgctcattattactttcaccaattgtactaaaactagttaacattttagccatccaggaagctcaccttaaaaaatagtatgtgcttttagcacaacattaattcgcaaattggccgaaattcaggatgaaaaccagtctgaatgatcatcttagctattctcaggaatggcaacgagtcagcggcttgacgatgacaaatgaagtgaggagagaaatatgtacaggcgtttactgttagcagcagctgtaacagcggcaatgtgtagtgcagttcaggcagctccgttagttgtcggtttttctcaaattggttcagaatccggttggcgctctgcggaaaccaaggttgcgaaacaagaagcggaaaagcgtgggataacactcaagatcgcggatgctcaacaaaaacaagagaaccaaataaaagctgtgagatcttttattgctcaaggtgttgatgcgatctttatcgcacctgtagtggctaccggttggacgccagtcttacaggaagcgaaagaagccaagatacctgtattcctgctcgaccgtatgattgaggtgaatgatccttctttgtatacggcggctgttgcctctgacagtgtatatgaggggaaagttgcgggtgagtggctattgcaagatgtagtaggcaaaccctgtaatgttgttgagttacaaggcacggttggctcaagtgtggcaattaaccgtaagaaaggctttgctgacgggatagcttcggcacctggcgtgaagataatccgctctcagtcaggggatttcacgcgcagtaaaggcaaagaagtcatggaaagcttcattaaagcggagcaaaacggtaaaaatatttgcgcggtctatgcgcacaatgacgatatggcgattggagctattcaggcaattaaagaagcaggtttaaaaccgggttcagatattaaaatcgtttccattgatggtgttcctgatatcttcaaagcaatgagtagtggcgaagcaaacgcgaccgttgaattaacgcctaatatggccggccctgctttagatgcattaattgtgctcaagaaagacggtacccagccacctaaattcattcagacagagtcccgcctgctccagccagacacggctaaacaggaatatgagttgaagaaaagtcttggttattgattcagatggcggggcttgcccccgcctgcttttatcacctgtattgggtcaatatctgagttgtttttgaacgtgggtacatctgatggaaatattgttagaagtccgtggcttatctgttgagtttcctggtgttaaggcattggactccgtagatttttctctgcaacgcggtgaggttgttgcgttattaggagagaatggcgcaggaaaatcgacattaataaaagcattaaccggggtttataaacgatccgctggtgaggtgctgttggacggcaaggctgtgtgccccattgataccgcagatgcccaactcatggggattggtactgtctatcaagaggtcaacttactgccgaacatatctgttgctgcgaatttatttattggccgtgagccgctacgttgggggctaattgatcacaataaaatgaaccagcaagcagcaaaattgctgacgggttatggtttaacgttagatgttcagcagcctttggctaatttctctattgcaatacaacagattgtagcaatcgcccgcgccgttgacctttccgcgaaggtgctgattctggatgagcctacagcaagtttagatgctaaagaagtcagtatgttactggatatcttgtgccagctacgggaccagggtattggtatggtttttgtgacccattttctcgatcaggtttatcgaatcagtgatcgcattacagttttgcgaaatggcaagctcgtcggtaccaaaactgtggcagaacttccccggattgagctagtgcaaatgatgctggggcatagttttgatgaacaattactgaaacgtggtgaacacagtattacgaataagaatccattggttgagtttaaaaactatggccgacggggtgtggtagagaattttgatttgtctgtatctcccggtgaaattgtcgggttggccgggttattaggttcaggacggactgaaacagcacagctaatttttggcataacgacacctgatacgggggaagccaaaatacaaggcaaaccggttaaaattagaacaccacgtaaggcatcaaaatttggttttggctactgcccagaagatcgcaaaacagagggtattgttggtgcggcaaccgtaagggaaaacatcattttagccttacaagcgcagcgtgggtggctgaggcccctttctatgcgtgagcagacacaaattgcagacgattttatccagcaactgggtattcgtaccccaagccctgaacagcaaattcaatatctctccggtggaaaccaacaaaaagtattacttgcccgctggcttgccacgaaaccccgatttttaattttagatgaaccgactcgtggtatcgatgtaggtgctcacgccgaaattattcggttgatcgaaaagttgtgtgatgaagggttggcgctgttaattatctcttccgaattagaagaattggcgggttacgctgatcgggtcatcgttcttcgtgatcgtcggcatgttgctcaactcgaccacgatgaaatttccgttcctgccattatgcaggcgatcgcggtgcaataaggagtggtttcatgggaaacaggagcctgtcaatgacacaacgaccgcgcaaagtaaaatgggttttgccgaaaggcgcgacacaatttggtgcactggcagttattttattgattgatagtctggtcgcaccgcatttcttctctatccatattcaggatggccggctgtttggcagtattattgatattttaaaccgcggcgcccccgttgctttattggcgctgggaatgacattagtcattgcgacgggtggcattgatttatcggtcggtgcggtcatggctatcgctggagcgactgccgcgacgttgaccagtgcgggatacccgttcatgacggtgctagcgctgtcactcgctgtcggggcgctatgtggtttgtggaatggtttcttagtggcggtattacaaatccagccaatagttgccacgctaatgttgatggtcgccgggcgcggaatcgctcagcttattactgaaggccagattgttacttttgatagtggcggtttggcaacgcttggtagcagtacgctgatgtatttacccatgtcagtggttattgcatgtagcatgttaattctggtgtggttgctaacccgtaaaacggcgcttgggttgttcattgagtcagtcggtatcaacttacgatctgctcggaatgcaggtgtgagtacccgtttagtgctgattgccgtttatgtgatttgcggtgtgtgcgctgcggtggcgggtattattgtgaccgctgatattcgtggtgctgatgcgaacaatgcgggcttatggctggagttggacgcgatattggcggtagttatcggtggtgcatcgttgatgggcggacgttttaatctactactttccgttattggcgctttaattattcagggtatgaatactgggattttactttctggttatcagccggagtttaatttggtgcttaaagccattgtcgtgctggccgtattagttgtgcaatccccgatgatctcattaagccatctcttccagaggcgaaaataatgttaaagcgtaatgttcccttgctgattactatcgccgtttttattctgggatatgctttctgtctgagtcaatttcccagtttctcctcctctcgagtatggtgtgatttactgactgataatgcttttcttggcattgttgctgtcggcatgactttcgttattttatcgggggggatcgatttatctgtcggctcggttattgcctttactggtgtgctgctggctaagttaattggtacctatggtattcatccagtctatgcctttgctatcgtcttagttatgggcgcaatgtttggtgcgttgatggggtggattattgattccctgaaacttccagcgtttatcattactcttgcagggatgttttttatccgtggtatgagttttatcgtttctgaagagtcgctgccgattaaccacccgatatatgaaacgttggctaattatgcctggcgtgttcctgggggtgggcgatttaccttgttagcatttattatgctgatggttgtagcttttggcatccttttggctcatcacactcgttttggtcataacgtttatgcgattggcggtaatagtgtttctgcggggttgatgggtgtcccggtcaggagaacgaccattaaaatttatatgctatccagtacattggccgcattatcaggcattgttttctctctctacacgtctgcgggttatgcgttggcggccagtggtgttgagttagatgctattgctgcggttgtcattggtggcacattactggcgggcggtatcggtacggtattcggtacgttgttcggtgtgttaattcagggcctgatacagagttatattactttcgacggtacactcagctcgtggtggaccaaaattgtgattggtattttgctctttagctttatcgtgattcagaaagcgatgagcgctttttatctcaaccgcagatcacgccctcagtcatcgccacttactcccgtgtaacgctctgggtcgcgttattcatgggggtttttaagagttgtctgatcaatgcttgctggtcactgttttgtagccaaacggcatacagtggccgcacgatcggtggaatgtcaggatgaatgacaagctgtgggtattctttttgccaatgttcaggcagaaaagcgcaaccgccagtcgtttcaagcaactggcgggttaaatgggcagaggtcgttgtgaggattggcgcctgctcactatcaagtaaacggttttcctgctgatggaaatcagccccccattcaagtttgatataaggcacttcacttgcatttttatgctcgttcggggtgtcatcttcttttggtaaatcaagggagaacgacgaataaagccgcagtgaaaaatggcctaatagcaggcaggccagttcatccattttgggcggttctgtcgtgatcaacaagtccagttgccgttcgtgcaactgcttcaccagtgagtttctcagcgcaatgcgtgcttcaaggcgtagttcctcttgttgttcatataactgttgcaaccatggagtgaggtacgcctcccaaagggatgcggttgcacctatggataactcagtgtgttgtagcgaatgtatgacttcttttttggctaatcgccaagtgttcagcagcatttctgcgtacggaaccagccgttcacccgcaggagtgagacgaatattattacgatgccgagtgaataagtttgcacctaattgattttccaactgacggatacggaaacttaccgccgactgtgttaagtacagagattcagctgcgcgaccaaagtgacgagttctactgacctctaaaaaggttttcagtaattcggtatccacaccatctccaattttttttatcgttaggatttaaatgttttgttttacacgctgtcaagcctatctaatactccgcgccataaacagcacgaccatgagagaattaggagcgtgtcagatggcggatagcttcatcacgaccaatcgtttttttgataataaacattatcctcgcgggttctcgcgtcacggcgatttcaccattaaagaggcgcaattactagagcgccatggctacgctttcaatgagcttgactcaggtaaacgtgagccagtaacggaagaagagcaacggttcgttgctgtttgccgtggcgagcgtgaaccggtcagtgccgaggagaaggtctggtctaaatatgtgatccggactcgtcagcctaaacgtttccataccctgtctggcggtaagccacagatggatgctgtggaggattataccgatagcgacgattaatctccctgcgtacttgaagctgcagggttgttagctgcgtgcactcacccgaatcacttactgatgtaagctcatcgggattcgtttactggctgcctacctgcaactccaattactttgggtaaaccctgtgtactttgaggttgtaaagatgttagctgcgtgcactcacccgaatcacttactgatgtaagctcatcgggattcgtttactggctgcctacctgcaactccaattactttgggtaaaccctgcgtacttgaggttgtaaagatattagctgcgtgcactcacccgaatcacttactggtgtaagctcatcgggattcgtttacctatcggtggttagttgagtattagggggctttggccccctttgttacatcaggcttttgtgcaactgcaatagcaggcgatccatacagcgatagctcagcgcctctgaaagatgacttttttggatggtcttttcttgcgctaaatcggcaatggttcgcgccactttcaaaatatggtgccaggcacgtactgacaggccgagtgtcagtaaaacctgctcgagaaacgcggcatcctcaggtgctaaataacaaaactctgctacctcttggctagtgagctgcgtattgatcttccccgcccggtccatttgcctttgtctggcctgtaacactcgctgcttgactgtagcgctactctccccctgatttttctgcgcacccagcataccggctggcagtaatggcacttctatcgataaatcgaatctatcgagaaatggcccggacaacttggccagatagcgcaaaatttgctgtggcggtgtgcggttatgaacgccttggtagtggccgctggggctagggttcatcgccgcgataagttgcactttggctggaaaacagattttggctgccgcgcgggagataataatttcgccagattccaacggttcgcgcagtgaatccagtacccggcgttcaaattcaggcagttcatcgagaaataacacaccgttatgggccagtgatatctcaccggggcgggggatggagccgccgccaatcagcgctgccatcgatgcgctatggtgtggggcacgaaaggcccggcaacgccattgtgttggcagtgcgttgctatgcagcaacccggtgatcgccgctgcttctaacgcctcctgatcggtcagcggaggcaataacccggttaggcgggttgccagcatcgttttaccggtacctggtggcccgagtaacagcaggttatgaccacctgccgccgcgatttctaacgcacgtttagcctgcgattgaccaatgatgtcgtgtaaatcaaggtggttatccggtgaaggggccggttcgaagggctggccctgtgcgagggggttttcaccttgtaagaaaccgcataccgctaataaatggtctgcgacccaggagttgccttgtgggattagaccaatttcaagaccattagcggtgggaaggattaactgacggttagcttcgctacaggcgagtgctgctggaattgcgccgctaacgcgccttaacgcgccggatagggctaattcacccaagaactcatagtgcgctaacttatccgcagggatctgctctgaggcggccaagatggctaaagcaatggggagatcatagcgcccgccttctttgggtaaatctgccggtgccaggctgacggtgatccgcttggcgggaaaattaaaaccgctgttaattaatgcgctacgaacccgatcccgtgcttctttgaccgttgtttcaggtaagccgaccaatatcaatccgggtaatccattgctgatatgaacttctaccgcgacaggaggggcttgaatgcccaatgttgcgcgagtatgaatggttgccagtgacattatgctttcctttgccgtcatgcgtcctgacgcacgatactgctccgtgggatgtttttattttgatgtgctcagtgtggcgataaatgagaacctaaatagggtgccgcatgcttcccttcagtacacaaaaaaatattcagtttgcgaaagctcacgagaaatttcgttgcaatgagtgaatcaaaattaaaaactgcgatgaggtatgcaaaaaaaggtcaagcggcggtgtgggttttactgattgataattaaaatgtttatagcatttggtctgtatgctcacaaaataataagttaaataaatattgtcagataaccaataactgtgataactctgtaggcattcgttcgacactagatagatgaacaacctaattatgaaagcaattctccaagtgattaacctagtcctaattagcgtggtggtgattattatcccaccgtgcggggctgcacttggacgaagaaaggcataaaaatcaagccttaatctcaagagaacccccgcaccgaaaggtccgggggtttttttattggcacgctaaaggacgcgaggagcataaaatgcacagcagaataaaatcctgttcctctcgaaaaaggtcggggaaataactatgaatggtgctcagtgggtggtccaagcgttgcgtgcgcagggcgttgatacggtatttggctatccgggcggggcgatcatgcctgtctatgatgcgttgtatgatggtggtgttgaacatttactctgccgccatgagcaaggtgctgccattgctgctatcggttatgcacgtgcaaccggcaaagttggggtgtgtatcgccacttctggtcccggagcgactaacctgatcaccggtctggctgacgctttactggactctgtgccggtgatagctatcaccggtcaggtagggtcggccttaatcggtaccgatgcctttcaggagatcgatgtgctggggctatcactggcctgcaccaagcacagtttcttggttgagtcattggatgcgctgccagagatcatggctgaagcgtttgccattgccaccagtggccgccctgggccggtgttaatcgatattcccaaagatatccagttggcggtgggggagttaacgccacacttgaagccagttgaagagcattccgttgattctgccgctgagttacaacacgcttgggatatgctggcgaacgcacagaaaccgatgctgtatgttggcggtggtgtcggcatggcgcaggcggtacctgccttacgtgattttatcgccatgacggggatcccggcggtcgccaccctgaaagggctgggtgcaccagatatcgcgcacccttgttatctgggtatgctgggtatgcacggtactaaagcggcgaattttgccgtacaggattgtgatttattggtagcggttggcgcacggtttgatgaccgcgtaaccggtaagttgaatacgttcgcatcgaaagcaaaagttattcatatggatattgacccggctgagctgggcaaattgcgtcaggttcatgtggcattgcagggcaatttaaacgtgttgttgcccgccttacaacagccgttaaatattcagccgtggcgtgatgaagtgatggcgctgaaacagcaacatcattggcgttatgaccaccctggtcaggcgatttatgcgccgttattactgaagcagatctcggagcgcaaagcccctgaaacggtagtgaccacggatgtgggccagcaccagatgtggacggcacagcatatgaactttacccgcccggagaatttcatcacttccagcggtttggggactatgggcttcggagtgcccgctgcggtaggggctcagatggcccgccctgatgatatggttatctgtgtctctggcgatggctcctttatgatgaatgtgcaggaattgggcacgataaaacgaaaacagttgccgctgaaaatcgttttattggataaccagcggttggggatggttcggcagtggcagcaattgttcttcgatggacgttatagcgagaccaatctttctgataaccccgattttatcactctggccagcgcttttgatatccccggccaacgtatcacccgtaaagaccaagtcgatgccgctctggatgcgctgtttaatagcgaaggcccttatctgctccaggtttccattgacgaactcgagaacgtttggccgttagtgccgccaggcgcaggtaatgaaaccatgctggagaaaatctcatgatacaacatcaactctcgatccaagcccgcttccgccctgaaatgttagagcgtgtcttgcgcgttgtgcggcaccgtggctttcaggtctgtgctatgaatatgtcaccaatgattgatgctgggaatgttaatatagaattgaccgttgccagccagcgccctgtcgatctgctgtcttctcagttgagtaagctgatggatgtcgcctgtgtcgagatcctacaacctaatacattacagatacgcgcctgatgcgccagaaggaaagaaaagaatgacgaagaaagcggattacatttggtttaacggcgaaatggttccatgggcagaagctaaagttcatgtgatgtctcacgcgttacactacggaacgtcagtcttcgaaggtgtccgttgctacgaatcccataaagggccggtagttttccgtcaccgtgagcatatgcagcgtttgcatgattccgccaaaatttatcgtatgcccgtctcccagtcagtggatgaactgatggaagcttgccgtgccacgctgcgcaaaaataatctgaccagtgcttatattcgcccgttagtctttattggtgatgtcggcatgggcgtgaatccaccggagggttataacactgacgtgatcattgccgctttcccatggggtgcttatctgggtgcagaagccttggagcaaggcattgatgctatggtgtcatcatggaaccgtgttgcacccaataccatcccaacggcggcgaaagcaggcggtaactacctttcatccttgctggtgggcagtgaagcacgtcgccacggctatcaggaagggattgcgctggatgttcatggttacctgtctgaaggtgccggtgagaacctgttcgaagtgaaagatggcatcctgttcacaccaccatttacctcgtctgccctgccgggtatcacccgtgatgccattatcaagctggcgaaagatatggggctggaagtgcgtgagcaagtgttgtcacgtgagtctctgtatctggccgatgaagtgtttatgtccggtactgcagcggaaattaccccagtacgcagcgtggatggtattcaggttggtattggcaagcgcggcccggtcacagccaaaattcaacaagcgttcttcggcttgtttaccggtgaaaccgaggacaaatggggctggctggatcaggttaatccataaaataccctgcgtatttgtcgttgcagcggtgttagctgtgccattcgcttgctcgcgggctgcaacttcaggttctttgggtataactgaaattatcagtaggtggttcgttcgctacctgcaatgcataagacatttgcaacacgcgatctatttgcaacacacaatttatttacgacacgcgatctatttgcgacagacaatttatttacgacagacaatttatttgcgacacacaatttatttgtgacacacaatctatttgcgacagacattgatttgcaaaataaaaacgcggagtgaagagacaatgcctaagtaccgttcccataccaccacccatggccgcaatatggccggcgcccgcgcactgtggcgcgcaaccggtatgaccgatgatgacttcggcaaaccgattattgcagtcgttaactcctttacccaatttgtaccgggccacgtacatttgcgcgatttaggcaagctggttgcggagcaaattgtagcttctggcggtgtggctaaagagttcaacaccattgcggtggatgatggtatcgcgatgggccacggtggcatgctctactctctgccatcgcgtgaattgatcgccgactccgttgagtacatggttaacgcccactgtgcggatgccatggtgtgtatctctaactgtgacaaaattaccccagggatgctgatggcgtctctgcgcctgaatattccggtgatctttgtgtctggtggcccgatggaagccggtaagaccaagctgtcagataaaatcatcaagctggatttgatcgatgccatgattcagggtgcgaatcctaatgtgagcgatgaagagagcgcccagattgagcgttctgcttgcccgacctgtggttcttgctccggtatgtttacggctaactcgatgaactgcctgaatgaagcgctgggtctggcgttgccgggtaacggttcattgttggcaacccacgctgaccgtaagcaactgttcttggatgcgggtaaatacattgttgccttgaccaaacgttattatgaacaagatgacgtcagcgccttgccacgcaacatcgcgaataaagcggcctttgaaaacgccatgatattggatatcgccatgggcggttccacgaataccgtattgcatttgctggcggcggcgcaggaaggtgaaattgatttcagcatgaccgatatcgatcgcctgtcccgtaaagtcccacatttgtgcaaagtggccccgagtactcagaaataccacatggaagatgtgcaccgtgcggggggggtcattggtattttaggtgagttggatcgcgctggtttgcttaaccgcgatgtcagtaacgtgttggggctgaatctgacacaaacgctggaagcctatgacgtgatgctgactcaggatgaaggcgtgaagcagatgtacgccgcaggcccagccggtattcgcaccactaaagcgttctcacaggattgccgttatccgtcactggataccgatcgcgaagagggttgtatccgtacccgtgaacatgcctacagccaggatggtggtttagcggtgttgtacggcaatattgcggcagacggctgtattgttaaaactgcgggtgttgataaagacagcctgacgttccgtggcccggcgaaagtatttgagagccaggatgaggcggtagaggcgatcctcggtggtaaagttgtggcgggtgatgtggttgttatccgttatgaagggccaaaaggggggccgggtatgcaggaaatgctctatccgaccacttatctgaaatccatggggttgggcaagagttgtgccttactgaccgatggccgtttctctggcgggacatccggtttgtctatcggccatgtgtctccagaagccgccagtggtgggttgattggtttggtacaagatggcgatttcatcaatatcgatattccgaaccgtggcattgtcttggatgttagcgaagctgaactggctgctcgccgtgaaactgaagaagcgcatggtgatgcggcctggtcaccgaagggccgtgagcgccaggtctcttatgccttacgcgcttacgcgatgttagcaaccagcgctgataaaggcgcggtgcgcgataaaagtaagctgggaggctaacacccatggcagtttcgcaacccttatctgctgccccctgcggggcagaatatctgcgggcgatattacgtgcgccggtgtatgaggtggcgcaagtcaccccgttacaagtgatggagaaaatctcctcgcgcgtgggtaataccgttttagtgaagcgtgaagatcggcagccggtacacagctttaagttgcgcggtgcttacgcgatgatctccagcctgacggaagagcagaaagcctgtggcgtcgtcacggcttctgcgggtaaccatgctcaaggcgtggcgctttctgcccataaaatggggattaaagcgctgatcgtcatgcccgttgctactgcagatattaaagttgatgcggtacgtgcttttggcggcgaggtgctgctgtttggcgctaattttgatgaagccaaaaccaaagctatcgcgcttgctcaagagcagggctacacctttgtgccaccgtttgaccatccggcggtgattgccgggcaggggacgctggcgatggagttactgcaacaagatgcccatcttgatcgggtttttgtcccagtgggcggcggtgggctggtggccggtgtggcggtgcttatcaagcaattgatgccacagattaaagtgattggtgttgaagccgaggattctgcctgtttgcgggccgcgctggatgcggggcagccggtcgatttggcgcgtgtcgggctgtttgccgagggcgtggcagttaagcgtatcggtgacgagcctttccgcctgtgtcaggaatatctggacgatgtgatcaccgttgacagtgatgctatctgtgccgcagtcaaagatctgtttgaggatgttcgcgccattgctgagccttctggtgcgttggcattggcgggcctgaaaaaatatgtgcagcagcataatattcagggcgagcgtctggcacatgtgctttctggtgcaaacgtgaacttccatggtttgcgttatgtgtcagagcgttgcgagttaggtgagcagcgtgaagccctgctggcggtgactattccagagcaaaagggcagtttcctgcgtttctgtgaattactgggtggccgttcggtaacggaatttaactaccgttacgccgatgctgaaaacgcctgcatttttgttggggtacgtttgactcgtggttatgctgagcgggttgaaattcttgctgaattgcaggacaaaggttatcaggtggtcgatttatctgatgacgaaatggcgaaactgcatgtgcgttatatggttggtgggcggccctcgaaaccactgcgtgagcgcctgttcagctttgaattccccgagtcaccaggcgctttgctgaaattcctgcatacgttgggcactcactggaatatttctctgttccactaccgcagccatggcacagattttggccgggtattggcggcatttgagttgtcggctaccgaaccgcaatttgaagagcgcttagcggctctgggctactattgccacgatgaaacggataacccggcgtttaagttctttttagcgggttaatcgcgatgcatacccgtcgtactttaagctgcagaggtgaacgaaagcaattagcacatatgcagcttggcgtctgacgggtatatcacttctgctgttcagatgatcaaattatataagagatgaaattttattcgcgtttcattttaacaattttattgttttcgtttaaaaaatatctatttccatcaaaggagaacaatggttcatcattttttatcttgtaaatagtcatatatttttctttctcgatacaatttttggtcgtattcatatcgctaaaacacagtctgtcgtactttccttcctctttataaccgtcaccaaaatcccaaaatatgatagtgtaaaaaccatctgatgcaggttttggaatgctatatttggctttcagcatatccctgttttctagccaccagtttattttccctttctcagtgaaagggaagtttcttactaaaatatcactataattatttctctgatgaacggagatgatttcaaccggatgccgtgataaccagaagaaataacccagtagaacgctgccaatcagtaatagtgcacagagattttttttgttttttactttcattgcggcccccagcaatctcacttgcgcttgattttaattatctcaccgttatcatttagtgagtatcgtccctcataagtaataaataatatacggtcattattgatgcgccttacagagaatactgactttttatctatacaattcttatcagttttcatatcctcaaaacatcgtctatcgtatttcccttcctctttatagccctcaccaaaatcccaaaaagtgatagaaaaaaagccatcaggggcagggttaggaatattgtatttgtcttttaatctacttttattttctaaccaccaatttattttacctttgtcagtaaccggaaaatctctcactaaaacagcactaaaattcccgtccttatgaatagcgacaatttccaccgggcgcaacgataaccagaagaaataacccagtaaaatgctgccaagcagtaatagcgcgcagatgatttttttactttttgctttcattacggcccccggtaatctcaattgtggcttccatattggtcataaatgcttgaggctaaactacataagaggcgaaattttattcgtgtttcattttaacgatttcgccattttttaactgatatatgccactgtccaaagtaaaagacattacgttatattggctatttcttataatcataagtgaatttttatctatacaattcttactggttttcatatcctcaaaacatcgtctatcgtattttccttcctctttatagccgtcaccaaaatcccaaatagtgatagaaaaaaagccatcaggggcagggttaggaatattgtatttgtcttttaatctacttttattttctaaccaccaatttattttacctttgtcagtaaccggaaaatctctcactaaaacagcactaaaattcctgtccttatgaacagcgacaatttccaccgggcgcagcgataaccagaagaaataacccagtagaacgctgccaatcagtaatagtgcatagagagtctttttactttttgctttcattacggcccccggtaatctctattgtggcttccatattagtcataaatggcttgaaaccaaactggttgaatcgttggaggacaaaccatatgcggaagaaatgaaaccggttaaacttggtattcttaatatcattattatccagcccgaagtgatcctgtattttgtaatgcaccatcgcgcgataacggtcattgtcgatctgcaatgattttatcgtgatatccgtggcccaggtatcgtgaacggtgatccccattccattaaagttatcctgaaatctatcgaattttggaagtctaccatcaagaataaattttcttatgtcatcttttttttctgctggatacagcttatttctccagtctatattttcatttaggacttttctcaacagcaggcgcgtactgtttttttctgtgtaatcactcagtatttgctctttcaatgcggcatctaaagacagatcccgaaacggtgtgccgttgccattctgcatatggtcgatcattttttcgatcaggtgtttatatgggccataaaaagcaaaacttcgtgattcgtggcgaaattcattaaagaggatcctgacacattcctgccgtgttatctttttgctctcaggatttttatcataagcataaccataaggcatgggctttagctgttggaacaacgttagcgtgtacgggttaaccttgcttgaaatattatgcagattaaaatctgtttttaactgtgttgcgcttagatcaccacaccgcatatcatcggcaccgtaatcatccatacgtttttgggttttaaatacagtacagggaaaatataacgcctgtaccgttgatttggtggtttctaacataatataaattccttttatgttgttaacggcttccaatatcccttatcaggccgcaggccactcgcgggataattgttataaagaccgtgcagttttctatttacagcgttccaatgcaagagtaatcccttcatttatagaatattcaaaattttcctacaaacgtgtatgcctagatcacttgggttgtaggaagggggtaagcgattcggggattatgtggtaatgattttttaacgtgacacagaattctgaacgctctcacaattttgtgctaataatgacataagccggataagcttattattgacacgcttatccggttaacaccgcctaaattatgatgaatagggttgccctatccatataccaacatctgcctaaggtgcctttgtggcggtttttctctaggcagtgatactataaaccggagggactacatagccaattttccctacactggaattatttaggatgtatgctgtcatatctagtcatattaaatttaaccttctattaatttattatgttatacgattttaaaatgaaattcgttattattgatgcgtggtcattattaagtggctacttattgagtgtttaaatgtaaacctcattcataaataataaattaatggagtgtatctatggaagataatggtgctgtagctaaagaaacgatagaaggtactgttgggtatataggggatgatatcagtttattgacatcggcaatgaataacttctcaagccaagtttctgaacaagttagcatgctcggtgctattcaaagtaatgttacaggtagcattgcaatgattagctgttattcaataggccgtgttattgccgcttaatcaatattattatcaatggtgtcactgatatttatgctattgagacaccaaggattataacaatccccaaaatgcatcaatcaacggctcttggagccgttttttcggtacacaaacccccaactcaaatggctcgactaacgagacatcatctagcagagaaatacggttacggactggctccgggctgttatccaccactaccgacgggatcagggcgacaccgcaacccaatgccaccatggaaacaatcgcttcatggccggacaccgtggcataaatcaatgggttagttatacgctggcgacggaaccataaatcgatacgttttcgtgacggcccgtgttccggcaagataaacgggatcatcgcccaatccggtttttcaaccgccacttgcgaacgcaccgcacacggcagtgcaggggcaatcaatactaatgggatttcaccaatctgggtaaaggccacgctggtggggagcacttcagggcggccggcgatccccaaatcagcctcattggattgcactttattgactgcatcggcggcatcacccgtggtgagtttaatttcaaccaacggatggcgtgcgcgaaagcggtccaaaattggcggcaagtggctgtaagcggcggtaacggagcaaaataagcgcaattcaccgcttagggaaggaccgtgctggcccaatgcatggagcaactgttgatattgtaagagggtttgttgggcaaacgcctttaattggttacccgcatcggttaattgcactgtgcggttatcgcgtaaaaacaggggctggccgatagtctcttccagccgctggatctggcgggaaagcgtagagggactgacgtgcatagctttggccgagcgcccaaaatggcggctttcagccagatgcagaaatactttcaggtcacgtaaatccatcacagacagcctcttggttgagatgatgtagtgtattgcataagaaatcgggtgtattgcagaaactgcaatatcacattgttaatatatcaatttccgcaatgtgtttcctgtcatatagtgaatccaagatgaatccccagctcagacaggggatgtgaaaaagcacaacacaacacaacattaatttgcagccataaaaatagtcattcgctatagcaaaaacggcgctgacaggactcaaagttactggctgcaatcaccacataaaacacgaacggagtaataccatggctaactatttcaacacattgaacctgcgtcagcagttggcgcaattaggtaagtgtcgctttatggcacgtgacgaatttgccgatgaagccggctacctgaaaggcaaaaaagtggtgattgtcggttgtggcgcacagggcctgaaccaagggttgaacatgcgtgactccggcctggatgtcgcttatgccctgcgtaaagaagcgattgccgagaagcgtgcttcatggcgtaaagcgaccgaaaatggtttcaaagtaggcacttacgaagagttgatcccacaggcggatctggtggttaacctgacgccagacaagcagcactctgccgtggttaaggcggttcagcctctgatgaaagagggcgcagcactgggttactcgcatggtttcaacattgttgaagtgggtgagcaagtgcgtaaagacatcaccgtggtgatggttgcgccgaaatgccctggtaccgaagttcgtgaagagtacaaacgtggttttggtgtgccgacgctgattgcggttcatccagaaaacgaccctaaaggcgaaggcatggcgattgctaaagcctgggccgcggccaccggtggtcaccgtgcgggtgtactggaatcttcttttgttgccgaagtgaaatctgacctgatgggcgagcaaactatcctgtgtggtatgttgcaggcgggttcactgttatgtttcgacaagttggtttcagagggtactgatgccgcttacgctgaaaaactgattcaattcggctgggaaaccattaccgaagcgctgaaacaaggcgggatcacgctgatgatggaccgtttgtctaatccagcaaaactgcgtgcgtatgcattatctgaacagttgaaagaaattatggcgccattgttccagaaacacatggacgacattatttctggtgcgttctccagcggcatgatggctgactgggctaacgatgacgttaagttgttgaactggcgtgaagagaccggcagaacggcttttgaaaatgcgccacagtttgaaggcaagatctctgagcaggaatattttgaccacggcgtactgatgatcgcgatggtaaaagcgggagttgagctggcattcgaaaccatggtggattccggcattattgaagagtctgcttactacgaatctctgcacgagctgccgttgattgccaacactatcgcccgtaagcgtctgtatgaaatgaacgtggttatctctgataccgcagaatacggtaactacttgtttgctaatgcagcggtgccgttgctgaaagagaagtttatggattccctgcaagccggtgacttgggtaaaagtatccctggttcggcggtagataacgcacaactgcgtgatgtgaatgaagccattcgcaatcacccgatcgaagccgttggtcataagctgcgtggttacatgacagatatgaagcgtattgctgttgcgggctaataaccgactttagtttgtgattttatattgagcctccctgtaaaaaaggggggcttttttatgtgcaccttagcaggcaatacgtaaggtagaattgccgaaaccccagggtggggtaagaatattaggtattccaacgggggcgataggcttatccagcaagcaatccgaccacatcccatgctttattacgaacctgaatttttaggttcgctccgccaggaggcatacaacacatacgaaatagccaaaaccgagcgagaagtggctgaacgaaatagagtgcagaagaaaccgtttggcttatttatagaggaaatgacgttacagaaaacattgacggatagccaagtcgcagaaacagcggcacatattatctgactggaaagtacgctgacgttactgaggcaagaagaagggcaggcatggcatcaatgtgagcaccttattcgtatacgtggcaataaaaaatttaagtacctccacgaagttcacgggctgaggaaattagcgcaggctaaacaaggagagatagatgttattaatcaatctattgccaagttaaaaacggaagaaatgggcctcttaatgcagcaacagcgtgttaatgccgatctggagacagcaaaaatcacagagccgcagcgagttgagaatgcacgtttaaccgcagaagcagcagaaaaggccgcgcgcgatcgcaggatcagtgaagagatagcggcaacagaagcaaagcgccagcgaatggagaatgagcggctagcagagcaggagcggcagcgagttgaaggcaccaaacagcaagtatcggaagcatcatgtgctcaacaggcctcagcctggcaaaatcgtttcacgttaccggcgcttcagccgtcaggatcagctcaatacagctttgcagcgtcgggaatgagtgctgttggggaagccgccgaattacacaattcatttctggcggcacaggagcaactcagtgcgatagcgaccatttcggcatcaggttcggtggcggcgatgattgctctggggatctaccagactaaagtgggagaaagctccgaacggccaccgggttggaatgttaatccgaaatttgtaggcagtatctcgctgagtgcaatggggttacctgcgacagaatcattggcatcacagggtgaaatggctctgccagtgcgaatgcggatcattgacgctaaagattggataggttgcacggagatatatgcggtaaaaacgggcgtggcaggtgtattgccgaaggtcaaagttggtgcagcgcagtacgatgaatcaaccggcgtttatactttcactaccgacagcacgccgccccgcacgctgatttttaccccggcacagccaccgggagcggaaacccgcccgatattagccccaccgggcagcacgccggccaccctgcagcacacgggtgaaatgatcataaaaccggtaataacaccgactatacttccactaccgcagttatatgcgcgtgatttccacgattacattatctggttcccggcagattccgggctggagccagtgtatgtttaccttaatagtccttatggtaaaacaactgctaaaggtaaatatagtggtcgtgactttaatccagataaagctggtggtccgattaaaaatctggactggaaagaaataaaaattaggggagagggtgtggatgaggtaaaactacatacaaggcgttttggtgaattagaggataataaattaatgatcgagaggttggagaaaattctcacaaacaaactcaccgctaccgctaccgatattgataagcgcttctatactcatgaaatcagagagctagaacgatatcgtatgctaggaataccggatgatgtcaatgataaatctgtttggaatgatgctcatacagcaactctggaagattttaaaattaatgaaaaaactcagccattatatacttcagaagctgaagatgcatatatcaaagcagagttaaaaaattcgttagggagtaaataatgtcaatcatggaaaagataattcaaaatgaaacagtagaagatgttctgttagcttttactcctaatacagcctatcaaggtattgagaggatgtatgtaagatatcgttttaatatagtctctaaccgagaacttttatttacttatcagaggctaataaaagaagccaagttggctgaggatgaaaagggccatacattaaaaggcccgaattggaaagagccgaaattcgtgaccgacaaaaaatacggcattgaataataaaaaatatgcttcagttaacgtccagtcaatgagtgtattgttgggcgtttttcttattttataataatcttaatgtgaaaatatatttatgatgagaattataagggggctatatttaggctggtttgataaaaaaagaagtttcttctcagctagttaacacttaacaatatgactgttagctctaattttattatccagactaatggtgggttattatttaaatagtaaaaaaatattaagttataatatgtttttctggcgactttttggcgcgaggtggcgaatgatcctgagttggttggtcagtttttacctttgaaccagaatataatgaaacgtggttatgctccatacccaataccaactcagcaggtaggaagaaaagtgaagtttgaacttcatcatgttaaatttattcgtgatgatggggcagtttattatattgaaaatataagagtaatgaccccaaaacggcacatagatattaattcaaaaaattgaggtgaataatgaaattaaaaaatagtataagtgagtatgctgaaggtgagtttttggattttttaaataaaatttggtctgtagatgtttctgaaagtgagcatgatgcccttatccgtcattttgtgatgattactgaacatcctcaagggaatggtgtgttattttaccctccagaaggggtagaaaatagcccagaaggtgttcttgactttattaagaaatggcgttccgagaacggtaagcccagttttaaagagtaagtgaaatatataatccgaaccgtcttaggacggtttaaatgttattgatataattaatggcataaatattaattcaatatttattttcccatctcgggagatgtttccacgatgatattatctggttcccggcagattccgggctggagccagtgtatgtttatttaaaaagtcctcgtgatgagccgggtgtagtaaccggtcgtggtgagcgaattacggggatctggctggcaggtgcgggtaaagatatgggggcacccattcccgctcagattgccgataaattacgtggcaggcggtttagtcattttggtagatttagggcggcgttttggaaggtagttggggaagacccaaatttagttaaatattttaaatcgggtaatctaggaaatattaaaaatggtaaagtaccatctcctaaagaacgtgagcaagtaggcagacgagtaaagtatgaacttcatcatctgaagcctattagtaaaaatggtgctgtttaccacattgaaaatattagagtattaactccgaaaaggcatatagatattcataaaggagcagaataatatggaagataaaagtatttgtgattacactgaatctgaatttttagaattagtaaaggagctttttaatgtggaaaaaacgactgaagaagaagatattaacaatcttattgagtttaaacgattatgtgagcatcccgctggttctgaccttatcttctatccagataataatagagaagacagcccagagggtgtagtgaaggaagtaaaaaaatggcgagctgaaaacggtaaacccggtttcaaaaaataaataaaatatataatccaaaccgccttctggtggtttggatttgtaaatataattagtaacgtaaatattaattcaataatttattttctcatcttgggagatgtttccacgatgacattatctggttcccggcagattccgggctggagccagtgtatgtttatttaaaaagtcttcgtgatgagccgggtgtggtaaccggccgtggtgagcgaattacggggatctggctggcaggcgcgggtaaagatatgggggtacccattccctctcagattgccgataaattacgtggcaggtggtttagtcattttggtagatttagggcggcgttttggcgcgaggtggcgaatgatcctgagttggttggtcagtttattattagtaatcgcgagcgtatgagtgtaggtaaggcccctaaagctaaaaaaattgattctggtggtaagcgtataccatttgaaatccatcatgttaaatttattaaagataatggcgaagtgtacaatatagacaatttgagaattttaactccaaagctacatatagaacttcattcaaaaaataaaggtaagcaatgaaactaaaaaatagtatttctgaatatacggaagaagaatttattgattttttaaaggagatatttaaagaaaatattgcggacacagatgctcgactgaatgaattattagaacactttgagtgtgttacggaacatccagaaggtactgatcttatatattacccactgtcagattatgaatgtacaccaaggaagatacttgaaaaagtaaaaaaatggcgagccgaaaacggtaagcccggtttcaaaaataagtaaaacatataatctataccgccttctggtggtttgggttgttaatatttatctgcattaaaaataataatgcactcataattttgatgctaattttatctcaataactattttttactttaattaaaaatagattaaaagtctatctcggcccgactaaatccttgtaaggtgctagtgctggttgagattatcagcccatctttgatttaaatattatttaattaaatgtataaaaaagataataaaactctcgaaaatgtgtgagagcggtttatattttttggggctgaatctaaatttaataaaaaccaatggaaaatacactatacccaagttacttcaagatgcaggtaggcagcaacggagtaacaaatgggtcgggaatcatttgaacagcatttatgctgcccgcagggtgagtctcaggggtgaggctcattaatctccaggcgcttatttatttttaaggtcagcaacactaagtgactggggtgagcaagggcggctaacgtccctgcatcttgcagggtgacgggtatataacaaggagagaaactatgagttatattcaaaccgtactggcacgctggggtgtttgggccagagataacagttgcctcgattatccgcatatttctagtggttttaaaggattagtcacaagaaacaaacccgctgagtcctgttgcgatcatgacggattggtcattgataatacggtaggtaatttacagcgcgcagcaagagaaaaagaattggaacttattcttcgtcattatgtttatggacaatctaaatcttctattgctcgattaaaaaaatgcaatgagcgtgaaataagacgccagttacaaattgcagaaagttttattgaaggatgcatcacgcaatctgatattttactggagatgcataaagagttattttgataataaaccaatgtttttaggtatgagaagttaaatgtaattatgactcaaaaatattgatagagatgtagattaaataaggatataacgcatagaaaatagaaataaatcgagtcgctcagccagtatggcggtccgcgagagtcgcagcatggtggatgagaggatcacgccagtgatagtaaaatcttggggtcatttgactatgaaacgggtaaataatttaaaggggttggtttaaaagacaatgatattaaagactctttgtgaggtaaattatggagctgaaattacgactaacgtggtttgataagcaagctgaaagttttattgatatatgtaagtgtgagtgctttattgaattttattatcgagataaatggtgtgtttttatattttagataataatatgtgtcatcatttttgatggtgatgcatatttcatggttatttgtcttttattggttaaatgatatatatacccaaactaattcgggtgattgagtgtgaccaactacatgtggcttgaagtgtgacgagcgtggatataacttcattgaagtacataacactagccctcaccatatcatcttaagctttaaggaacgttatgtcttataaaatacttggtgggattataacggcattggtagcttcttttctattacttcttgtgcagtggagtaacctgtcaaagcaaattgaaaataaagaaaaagagttggtgacagtgcgggaagcgaatgttgtattgaaaaatattcttgatatttatcatgtaaatgatatgtccaatcgtgttgctactgctcgtcaattagagaatgagagggtattacgtaatgaatatgaagagaacattaggcagttcaaggcagcgacaattgatgatttttgtgctgctcaacatatgcctgatcgtattattaacctcctgcaagagtaaatcacctgccctaaaatctatcgacgttattcggttatctcctccagagtcagctttaatttcttgtgaaatacccgaattcaccggtgctagctggggcgacagcggtatttatacgttagccttaaaacgtgaattacagatttgtaaaagacgattggatgaggttatttattggctgatgggcagcaattcctaaataagtttccggtgtctgtgcgctactcgcccccaaactgccattcccagcagcgcactttatttcaactcatggctaaaagagtttcggttgcctaaatcatcaattaaatcaaaattgacggttttgttgtcgctaattggcgctcggtttagtggaaaatctaattgagagaacggggccaccatttccggagggccttcggctgaaccgatggtcaaagcagcgaaggatgcatagtaaggggttggattgttaaccttaatcagcgcactgtcgccgttacgctcgaggctaaaggttaatgccttgcctaaaatatctcctggcgcgggtaggtttttagggcggtaaaagactttatattgcatccgtagggccagcgtaacaaaagattcatcaccggatttgggggttgccttaggcgggatttcgtaaatatttagccagaatgcagattccctatccgcaggtaatttactcccaccagataagatcaaccgcaggctacgctgtgcctgaggttgtaaccggaataccggaggtaacaccaatatgggtgaaacagccttatcaggcgtcgccatcaaattgccgtcatccacccaaacttgtaccgctaccgggtagctattgctgttaaccagttgcagtgactcttctgtactgccttcactgaagacaatacgtgttctctctgcaatcacacttgccactgcactcgttgccagcgcactcattatcagcacgccaatcgtcagcgcagggagagtcagtacacgacaggtggtcatgagtagcagcaacccacggagcctacggttgatacggctaagcattatattattggacacggataaccacttgcgcatgtgcattcactgctccggcggtcaccgtttgcccgcttattttgcttaactcagcacggaaagtttcggtgtaactgttccccccatctacgctgcctgtggtttcttgtgcgccctgtaagataccataccaccccccattgttacctgtctgagttacgttttttgacagtagatacatcgggctattgttacggtagatgcgaatacccaccccgcccgcggtgccagcagcgccatagttatcggagaccaaatggcttactcccccgttgccgttcattaaccccagcgcctgagctttggctgcattggccgccggcactaaaaatcccatcgccactgtgccagccgtcacgccagagttaatcccggtctggcactgaaaatccacattaaaatcagcggagctggtattcccattattcagttctgccaccgaaatcctgggtaacacgaccgtcggggtaaagttgcttaccgcacaaatagtggtccggcggaatgtgacgtatttgtacaaaccaagtgatgcaggccaggtagaataccaaccgggccagtttgagtacgagtcagtaccctcaatcgggccagtaattcctggccctttaaacgcgatataggcattgggctgactacgtccatagagataagatggcgtattgttagcgccactacgggcataatcaatacgaaatagctcggtatacacattactgaaatttttcgctttaactaaaatccgtccgctactgtcagtatcaagcccggttaagcgtcggcctttccaaatacgagcgtaatactcccccgttgccaggttggtaaaccgaataaccacattcatcactgtagtagcatagccataggacacattgcctgcaatcgtgccgtcttcatatctgccaccataagtgctgtcaccgttagtggcatacatctcatagagctgatccacatcagccgcatcacagcgaaagaggacctggtcaagggcataaccggtattcactgcaaaggtcgtaaagtctgaggttgctgatgccagtaacgtgccatcgggctgaaaattcgcattggtgctgagatcaacaatactgggtaagttgagcgaaccattattatcgtctctggaacccaaccatgaagcggcggtaccatcactggaacttatctgattttgtgcggtaatacgggtgcagtttgaccatgcggaggtgctaaataacccaatcagtaatgtcatcccagcaagaaaatatgggcggcggcaatagaccgcagtggtagactgcgaaatgccggaagatattaatggctttgttggtcttaacattatttttctcatagggttagcggcggcaactcgcggttatatgaatgatatcttgctcggtatcctggcgattaaaagcataaggtaattgacactgatcaccgctgctttcgccccaacggacatcaagtgtacctttgttatcggctatccgtgcgtagatctgattcccctgacctaccattccaaccagttcatctttgctgttatacacatcggcacccaatggtaacctctcaccttcggcttgaattaacaccgcatagccagtcagtgtttcaaatttcacttttaccgctgccccggcataagggacgacacggccctgattctctttcaactcggtgttacggttaatccccttggtatccagccctattgtgttgtagttataaggcgttagcgcgggcaccagagcaaaaccgttactatcaattcttgccccttgggcattacgaactgtcgccccttgagcaccattagcttcaattaaaccaaaggtctcacccagataagggcccagagtcacgccttgtcgatgtattaccgccgcaccacgagcgcctgcgccatattgggtgtaattattgccacgagaatagctgccattaacggtagcattggggaattgcttctgtacgttggccccccaattatttgagctactaccgatgttgctgtcgtcatagcctgcatttaatgcatagttgaaggaatttcgctcaccggcggtgcctgataatgatgtttgatagttattaccgcttttcggattacggctagctgacattgatagatattggttgttgctaccaatattcagtggaatagaaacggtgaatgttgcgatgttctcggtattaccgtagcgcgtggtggttgccgtctcgtcggtatcagggctatcccagttatacagagtggaggtataaacactgcgctggcggctgacagccaaattgtaactgatttgctgataactatttgaatagcctagctgtaactgggtatctctcgccgtatcgttataataatcactggttgaggcagaggcgtataactggccccaattaccgaggtcttgattaatagtagtggtgaattggctacgctgtttataggttgatgaatcccacgttcccccgtttttttgcatcgaacgcaccccgaacacatcatttaaatcgcgataccctttcgttgagtaacgatacccggctaaagagaacgtggttccggtttgattaaaggtctggctataggtggcctgcatccgccaaccatcttgcgttttatcattttcaactttggcgtgagaataggtggcattgaggcccaaagcaccgaccggtgtccctaatacgccaccggcaagtaatgccgtgtagtcttttgctaaacggacaccactgttggccgtcagttgattggtgaggccgcgttcataggtgaagtcagtgaaataattatcaatattggtgaaatcgcgtgattccccgatcaccgcattatagcggctaacgcctgggcgcattgaatcaggaacggcactgaatggcaccgtaaatgtcgagcggctaccattggcctcaataacctcaacattaaggtcgccttggctactggtgctgaacaaatcgttaataacgaacgggccaggagcgacgttcgtctcataaatttcacgtccattctgacgaataataacgcgtgcgttggtactggcgacaccccggacctctggggagaaaccgcgcattgacactggccacatgcgttggtcggtagccattttcgcaccgaggaacgacatgctgccaaataatgtactgtcagtgaaagtttcgcctaacgttaactggctatccaactgtgggatcgggcgttgcacataagtgcggatgctattccactgggtatcgctgccactatcattactggcgtagcggacgttcgattgctggcgtacttgccacaatcccagattgatcccacttttaaggccaataaaaccaaaatcagaggttctcttttgctggccgcgagtatcactgcgataagcgttggcgctgtagttaatgaatgcgagtttttcgccttcctgccattccgcccgctcaatgtagcccctgggccgtttttgtaatagagcctgtggaatcgaaagctctaaacgtaatttagcctgatcaaatcgaaaggatgccccttttacccgcgtagacagaggtaaacattggttcgttggggcgtgagtttcagttatgggagtattagcctcggtaacatggggttctttgggaggggtgctattttctctacccagttcaacgccagccgcggttaataactcgtcgctcagacagggataaacctcagatgagttggcatctttaataaattgcacgctcatacgtttgaacaatttgttattaaccaaaacatctacagcatcataattcccggcagttatagaattttttttattaagctgggtcaaacctgatgcatattttgtccctaaaaaaagagattcatcaaattcgaaattttgtggttcttcctgcccaaaagcagtatcaatatgtaaaattaaagttatacataatgttaatgctttcctacggcctgagaaattttttttcagaatgacccgtgcctgcaccataaatattcctttaccggaaagttactgctaaatacgatagctaccggcatcttgcccgccgaaatcattcatgatcagaaagttaatcgttgctgacgagggtacggatgcatttgggatcacccactcaacttgagacataggcgcgatcatatttgattttactttaagttttatgctcccactcacgatttcaccactggcaattgtggcatagaatccagttgggttttttcctgtcaaaacaaggttagttccttgttttcgtagactaaaagtcaatgcggtagagacttggtcaacacggccgataatactctcgggacgataaaatactttaatgcggttacgcaacagcactaacatcttgttatctttctctactttattgacgggagggatctgtaaaaagttaagataaaatacggattccctatctgtaggaaggccacttcccgtatattttaaccgtaatgtttggccagaatttgcttcaatacgaaagaacggtggagtcactataaagggggctttgcctgtttctggtgtcgatttttcatcgccactgtctaaccacacctgaacagcattagggaaattgtcattattggttaactgtatgctgtgctcgcttgccgccgcaggatatataatgcgactccctgtcatcacgacactggcattagcaaaagacagactcatagccactaataaagttacaaacagataatgatagtggcgggcatatatactaagcatgatgagcgtaccttctgaagtcatttaccgagtggttataccacccggtaataaatacatttattacaagtaagaaacagcatactgtacagatgcaatgacagaccctggtgttgattgcccagtggcataatactgaacagcaaaatcatgctccgcagatgtatcacctgctagcaatacgataccgtcttgtgccaaaccactatttaggtcgatacccgttgttgtcgtggcatccttcaataattgaagttcaacgttccctgcggtacctgtattttgtaaattaccagtagcagtaaccaggctaccgatgaaaacagttttgatatcaagatcatctgatcctgatgtacagccagacacacctagcgtaaaggttgttttgcctttagtttggccggaagcgtctaaatcgctacttgatactgtaggcaacaagacaactggatttgcttcaaggccgtttacggtaacagaacaggtttgtgctgtgacttccccttggaacgtaatcgtattattactggcagacatggcaaccgttgtagatgccgagaataacgcgatagctaaagtaatttttttcatttaaaaccccgatgtaatcattgaaatggagttaattccccattcggattttaataaaatccgaatggggaatttgattgagtgaatatatattccaacattttcagtttttattattcgtctcaaaataccttttaatttcaaaggtgttttgatgttttttttctgtgtaattattattacatgagacaatcatatagaagctaatgttggtttcacataggaaaaggtaaccgagtcgtgtaggaatattcccatattgcttttattaaataattgtagctattgttttttaaatgttattaagagagtgttaaataagggttttattgttattttcattaccaatcatacccttgggtattatttttcgatatatttaaaagtctattttttaaatgttgctatttatattcctctaaataaaaccaagaaaaaccaatgtcttatacaagagtatgataacgcttatcgagtgttgcattaatacttctactgtaattaaggcgcgtaataccttctaaactaaagatatgatggagtgttaagtattgttaatgaaatatgggttattataacagaattttttattagcgtgcgttggaatgggttatcttaggtttatggttaaaaggggatgaataaaacggtgatataaaaaattaagcttaatgcaacgattcactcaaatcttgtactctagcgatggatggcatcagcttctctgagagtgatactgtcgacggccaagaggtttgacgaccaagaggaaaatgataaatgccagcaagtcatttggatgttaaaaatttcacttcaaagatgttggaccagttttttccagtgaggtatattttatttttgcttttatcgtaagcaataccattgagtgtattagtgttacggttgactgaatcgagcatgaattgtagccctgacaactcaatccacttaaccactctaccattttcaggttcaatcactaatatagcatcgctataccatacattggcataaatcattccatcaatccattctagctcattaattttttcaattcttcggccatcaaaggtcactgatattttttttataattgagaaatctgctgggttacgaaaataaagagtatcgctcccatcccccataatgagattgataccatcggtcgttaacccccatccttctccttcataattgaatgtttttataattttcaaatcattagggttaatgacaaatgcttttttttctttccaggttaatacgtagaaactatcacctaatttagtgatcccttcaccaaaaatattatctggtaaatccactgacctaatgaccttaccattggttaagtctaactccctgattttagagtttttatagaggccggtcgtttcatataatttaccgtcatcaatgacaagcccttgcgtaaaagatgtttcatcatgcggaatttttcttatcacttcaaaggtatacttcagaggtttagaatctgcgaaagataaaggaaagctatatgtgattataattaataaaaaagtaaagcaacggcgaggtatatttaatatctccattaagccaccttgataaataaggaaattttatttttataaaatattttctaaaccatattacctaaattttattgcaagtaaataaggtttggctaactgtagggtaactaacagatcattttacaattaataagtaagtgattcgagttattgatagcagctaatgcacatggagtttgaagtatgacgagtataaacatgaaatacgccaccttttatagcgtggcgtatttcaggattagctgcggtacaacactttaatgatgtgatatccaaactgagttttgaccgggccataaggttgcagcaattcgcagctaaataccgctttatcgaatgcagggaccatatcccctttattgaactcacccagatcgccaccgttgcgttttgacgggcagttagagaactttttcgctaactcctggaaattagccccgttattcaactgggccagaatgtcatttgcctgcttttcatcatcaaccagaatatgcagtgcagaagctttgtttgccatagtaacagtcaccatcagattattttaacgacagggttattttacgcagagtctcttcgataggctcgcggagcgcgtcagtgtaacgtattttggttgccgctgcgtgcgtattgccaatcaaaaaagcaggcagttttttttcatctgtggctttctggtacaattcgcttccccgtaaacccattgagcaaccgagcgtcatgcgattaaaccccagccaacaagaagccgtcgaatttgtcactggaccctgtctggtgctggccggtgcgggatcgggtaagacccgagtcattaccaacaagattgcccacctgatccgccagtgtggttatcagcctaagcatattgctgccgtgaccttcaccaataaagcagcccgcgagatgaaagagcgtgttgctcaaacgctggggcgcaaagaagcgcggggattgatgatcgcgactttccacaccttggggttggaaatcatcaagaaagagtatgtggctctggggatgaagtcgaacttctcactgttcgatgcacaggatcaaatggggttattgaaagatctgacccataagtggctggaagatgacaaaacattgctgcagcaactggtgtcggcgatctccaattggaagaatgatctgctggatccagccgccgctgctgcgacagcacgatccgagcgtgataagttatttgtccattgctacggcttatatgacgcccatttgaaagcctgtaatgtgctggattttgacgaccttatctcgctacccaccctattgttgcaaaaaaatctggaggtccgtgagcggtggcaaaaccgtctgcgttacctgctggttgatgaatatcaggataccaataccagccagtatcaaatggtgaaattgctggtggggaatcgggcgcgttttactgtcgtgggtgatgacgaccaatctatctattcatggcgtggtgctcggccacagaacttggtcctgctaaatgaagatttccctgcgctacgggtgattaagctggaacagaattaccgttcttcggggcgtatcttgaaggcggcgaatattttgattgccaacaacccacatgtttttgaaaagaaacttttttctgaactgagctatggcgatgagttgaaagtgattaccgccaataacgaagatcatgaagcggagcgggtggtcggcgagcttattgcacatcactttgttaaaaagacccaatatagcgattacgccattttgtatcgtgggaatcaccaatcgcggttgtttgaaaaattgctgatgcaaaaccgtattccttatcgaatttcgggtggcgattcatttttctctcgtccagagattaaggatttgttggcttacctacgggtattgaccaatcaggatgatgacagtgcattcttacgaattgtgaatacaccaaagcgtgagattggtgcggccaccgtccaaaaattgggtgaatgggctaatttacgcaataagagcctgtttcgggccagttttgatttagggttaggcgagcacctgaagggccgtggcctggagtcattgcaacgttttactcactggatggatgggattattcgtttggttgagcgtgaacccgtggcagcagtccgggatttgatccacggtattgattacgaaagttggttattcgaaactgcgcccagcccaaaagccgctgaaatgcgtatgaaaaacgttaatttattattcagttggatgaccgaaatgctggaagggtcggaactggatgaaccgatgacgctgactcaggtggtaacgcgttttaccctgcgtgacatgatggagcgaggggagagtgatgaagaactggatcaagtgcaattaatgacgttgcatgcctctaaagggctggagttcccttatgtattcttagtggggatggaagaggggttgctgccgcatcaaagcagcattgatgaagataatgtggatgaagaacggcggttggcttatgtggggatcacccgcgcccagcgtgaactgttcttcaccctgtgtaaagaacggcggcaatacggcgagttgattcggccagaacctagccgttttctgatggagttgccgcaggacgatttaaactgggaaaacgaacgtaaagccgtcagcccggaagagcgtatgcaaaaaggccagagtcatctggccaatcttcgtgctcagttagcgaatgcgaagaaaccgtagttaatatgaaaagccgtagttaacacgaaaagcagcagttacagtagtgaagataataacgggcagtctattgcccgttagccatgcattaaggcgcgactgattgaccatcaaccgtgacgtttttaacgtcgctgaaatgctatgggtaatccccaccaacacacttagctaagctcttccaatagcagtggccattgaacataactttgccagtgactctcttgttctaacgcttcggcgcggtaggggtgctgttccaaccaaccttgggggaccagcacataaagcgcattattatcggcccgcaacctgactgctggcagggtatcatcccggcgacggctggaaaaaataatggccaagcgcagtagacgacacaaatgctgtgccatgtcggcaggtaatgcattctgctggttcaagagcgataggtcgatagtgtcactctggttttgtaacagagcagaaagtagcagcttttgtgcaggggtaaaaccgggtagatccagattacggatcagataagcggcatgttgcggagcatgtttaaaatcgacactgaggccaatttcatggatcaaacaggcgttttgcaaaaattcgcgacatcggccatcgagatgccactctttttccacttgtaggaaaaagttatccgccaaacaactgacgcgcttagcttgctcggtatccagtaaatagcggcgctgtaaattacgtagtgtccggcggcgaatatcttgctcgaccggtaaatggagcatgccatagaccagcccttcgcgcagtgcgccacctgccagtgtcatgctttcaatggacaactcctggaatatcgcaattaagatggacagaccactggggaagaccagcgctcgttccaaggttaaaccagggatttccaactcttctaatttgccacactgaatcgctctttgtttgagctgttgcagcttggctaaggtgatcagctcgtccataccttgagcgaccatgatctcttgtagtgcctgaacggtgcctgaagcgccgacacaaacttgccagccatgttcacgaaaacgttgggcgacgggcttgatcatctcatgagcggccaattcagcgcgttcaaaattttcctttgccagatggcggtcaccaaaataacgttctaaccaggtaacacaacccattgataggctgaccaaaatattcgcctgagccccattgcctgtaaccaactcagtgctgccccccccaatatcgacgaccaaccgctgttctggcccgccagtcgtatgcgctacgccatgataaatcagacgggcttcttcttcgccactgatgacttgaatagggcagccgaggatctcggttgcagtacgcaagaattcgtcggcattagaggccaggcgcaaggttgccgttgcgaccacgcggatttgatccagaggaatatcctgtaaacgctctgagaaaagttttaggcattgccagcctcgttccatcgcttcctgcgatagatgattttggttatccagaccagccgccaggcggaccttccgcttaatacgtgccagcgtttggatactgccagccacctcacgtactaccaacatatgaaaactattggagccaagatcgatggcagcataaagtgaggtggaacttagcatcatttatcagcctggtcgcttacggttattccgtggtgctccactgcggcgtggggcagaattacggcgtgggccattcccggtgcgggtacgggccaggcgtttaggcgctggtagatcagttaatagcgcgtcactgttatatttgcttaccgggatgctatggcccgtataggtctcaatcgctggcaagtttaatgcatactcttcgcaggccagactgatggagtgaccactctcgccagcacggccagtacggccaatgcggtgaacgtaatcttcacagtcatctggcaggtcatagttgaagacgtgggtcactaatggaatgtgtaaaccacgggcagcaacatcggtggcaaccagaatatccaaatcgcccttggtgaaatcttcgagaatacgcaggcgttttttctgagcaacatcacccgtcaataaaccgacgcggtgaccatcagcagccaaatgcccccagatctcttcacaacggtgtttggtattagcaaaaataatacagcgatcaggccattcttcttcaattaacgtctgtaacagacgcattttttcttcatttgaaggatagaacagctcttctttgatgcggtgaccggttttttgtaacggttccacttcaacatattctgcattattcatttgttcgaatgccaattcacgtacccgatacgagagagtggcagaaaacagcatatttaaacgtttatcaacggaaggcatacggcggaacagccagcggatatctttaataaagcctagatcgtacatgcgatccgcttcatccaataccacgacttggatcgcaccgaggttaatataattttgtttcgcgtaatcgattaaacggcctgttgtaccgatcaagatatcaacgccactttccagcactttaagctgtttatcgtagccatccccaccataagccagacctaacttcagcccggttacctgggaaagtgattctgcatcggagtgaatttgcacggctaattcgcgcgttggtgccataattaatgcgcgtggttgattagtctggcgaccctcttctgctgggtgagaaagcaaataatggaaagtagacgccaagaatgccagcgtcttgcctgtaccggtttgcgcctgacctgctacatcacgcccagagagggtgagtggcaatgctaacgcctgaatcggcgtgcaatactgaaaccctttgttttcaagggcttcaacaactagcgggtgcagggcgaagtcggaaaacttctgttcagtcaagtgtgttttgctcatagtgtggtagaatatcagctaactattgctttacgaaagcgtatccggtgaaataaagtcatcctactgttggttaatgctacaccaacgaggtagacacaatcctttggagtagaacatgagcgataaaattattcacctgagtgacgacagtttcgatactgatgtgctgaaagccagcggcttggtcttagtcgatttctgggctgaatggtgtggtccgtgcaagatgattgctccgattttggatgaaatcgctgaagagtatgaaggtagactgactatcgctaaattgaacattgatgataatcagggcacagcaccaaaatacggtatccgtgggattcctacgctgctgttgttccgtgatggcgaagttgtcgccaccaaggttggtgccttgtctaaggggcaactcaaagcgttcttggatgcaaatctgtaatcggtgctagccgtctataccccaagtcattggagtaatgagagccgctaacacagcggtggcctcaaggacgtagggtatgtttagcggcagttgtgatttctcacactgaccgctagacgcctgcaaagaagcgtgttaagtttacctcactgcatatagaacattcctgtgtattgagtccgggtctgtagcatctaaacagtttgaatctaaagttttactctatgtcgaattgatttgtgttgagaatatttatgaactcaatcatttttttgacagtctaatggctttacaaaatcagtctaaggcaccttcaatctttataccgttgtgtcgcaaaaatcttgcgtaagtcattacttatgtagtttgcccaaggccggtggttgaatgtcccattaacaggcacgtatgacgctgccataccattcacgaccatagttcaagacataccccgagtttaagaacccaccattatgaatcttaccgaattaaagaatacgccggtttctgatctgataacacttggcgaaaatatggggctggaaaacctggcccggatgcgtaaacaagatattattttctctattctaaagcagcatgccaaaagtggagaagatatcttcggtgacggtgtattggagatattgcaggatggatttggtttcctccgctctgcagacagctcctacctcgccggtcctgacgacatctatgtatccccaagccaaattcgccgtttcaacctccgcactggtgataccgttgccggtaagattcgtccgcctaaagaaggcgagcgttattttgcattgttgaaagttaatgaagttaactatgacaagccggaaaacgcccgtaataaaatcctattcgaaaacttaacgccgttacatgccaactctcgtctgcgcatggaacgtggtaatggttcgactgaagatttaaccgcccgtgtactggatttggcatcgccaattggtcgtggccaacgtggtctgattgtggccccaccaaaagccggtaaaactatgctgttgcagaacatcgcgaccagcattgcttacaatcaccctgattgtgttttgatggtattgctgattgacgagcgtccagaagaagtaaccgagatgcaacgtctggttaaaggtgaagttattgcttctacttttgatgaaccagcatcccgtcacgttcaagtcgctgaaatggttatcgagaaagcaaaacgtctggttgagcataaaaaagacgttattatcttgctggactctattacccgtttagcccgtgcttacaacaccgttgtacctgcttcaggcaaagtattgaccggtggtgttgatgcgaacgcgttacatcgccctaaacgcttctttggtgccgcacgtaatgttgaagagggcggaagcctgaccatcattgcaaccgcgctggttgataccggttctaaaatggatgaagttatctacgaagaatttaaaggtaccggtaacatggaattgcatctgtcccgtaaaattgcggagaaacgtgtattcccagccattgacttcaaccgctctggtacccgtaaagaagagttgctgactacgactgatgagctacaaaaaatgtggatcttgcgccgaattcttcatccaatgggtgaaattgatgcaatggaattcctcatcagtaagctggcgactgcgaaaactaacgatcagttctttgataatatgagacgctcgtaagcttatacgcctaaagaaactggcgttgcaggggaatgtgtgtagctagcacctctgtggcgtcaagtactaaaggtatagttgagtcactatatagttgaatcactatatagatgaatcactaaaggtattgtagttgaatcagtcaaaacgccacgccagtcgtggcgttttttacttttggaatatacgatagttgggatcattgtccatggagagggtaaaaatatcgaactgacaaatattttcgtatctatacccaaataattcgagtttcaggaaggcggcaactgagggagcccctaggagcttatacagataagtgactgaggtgaatgaaggcagccaacgtacatacaacttgaagtatgacgggtatattctcataaccaatgtgacaataccaaaatagagtttggaatagccaataaggctatcatcatattcagatataactgaaagcgtgttgggggcatagcaagtgctaatctacatgctaagctgttgtatctttttgcagagagcggttaaacgtgaacctactcactatgagtactgaattaatttatatctttctgttttctatggcatttctatttgttgctcgcaaagttgccataaaaattggacttgtcgataaacccaactaccgtaagcgccatcaaggattaatccctctggtggggggaatatcggtattcgcgggggtctgttttgcttttctgattactaatcagcaaattccccattttcgtttatatcttgcatgtgccgggttattggtcttcgttggtgctttagatgatcgttttgatatcagcgtaaaaattcgcgcttttgttcaagcactggtcggcatcgcgatgatggcagtcgcggggctatatttacgtagtctggggcatgccttcggtccatgggaaatggtattagggccatttggttatgtggtcaccctgtttgcggtttgggcggccatcaatgcgttcaacatggttgatggaatagatggcttgctgggtggcctatcctgtgtttccttcggggccatggggattttgttgtaccaaagtgggcagatgtcattggcgttatggtgtttcgccatgatagccaccattattccctatatcttactgaatctcgggttactgggtcgccgctataaagtcttcatgggcgatgctggcagtactttgattggtttcaccgcgatctggatcctgttacaggcgactcagggtaatgctcatccgatcaaccctgtgacggcactatggattatcgccattccgttgatggacatgattgccatcatgtatcgtcgtttacgcaaaggcatgagtcctttctctccagatcgccaacatattcatcatttaatcatgcgggccggttttacctcccggcaagcttttgtcctcatcacactggctgccgcgttgttagccatgattggtgttatcggcgaacggctgacatttatacccgaatgggtcatgttggcattgttcttgcttgcatttctattgtatggctactgcattaaacgggcatggcgggtggcgcgttttatcaaacgtttcaagcgtcggatgcggcgggcatcgaaaaataagcatgaatcttaaccagaggcttttaggcagtgatgaaaccagaatctatgtcgactgataaaacagggtctaccaataatgaaccgtctgtggataacgaattagatatccgtggtctgtgtcgtactctatggcgtggcaaggtatggattatcggtatggccattattttcgctgcgattgcactgggagtctcctatctggtgaaacagcagtggagtgcgacagccattactgacaaaccaaccgtcaacaatttgggggggtattattcgcaacagcagtttttacgtaatcttgatatccgtctcaatagcgggcttgtcagtgaacagccaggcatctccgatgaagcttacggtgagttcattactcagttagcggcttacgatacccgtcgtgatttctggctacaaagcgattactacaagcaacggcttgaaggagacgctaaggcggatgcggcattactcgatgagctagtgaataacattgttttcacggcgcgtgatgataaaaaaatcccgaatgacagcattaaattgacggcagaaacggccagtgatgcgaataagctactgcgtggttacattgattttgccagtcaacgtgcgtcaagccacctgaatgatgaaattcaaggcgcttgggcagcgcggactcaatcaatgaaagcgcaggttaaacgtcaggaagcggtagctcaagcagtctttgatcgtgaagtggcggcggttaagcaagcattgaaagtggctgggcaacaaggtattacccgtagccagacagatacgccagccgagcaattggcagattccaagatgttcatgctaggtaagccgatgcttgaagcccgtttagaaacattactggctactggcccaagttttgatattgattatgatcaaaaccgtgccatgctggcaacattgaacgttggtccgacactagatgataaattccagacttaccgctacttacgtacaccagaagacccggttacccgtgatagcccacgtcgtgtgttcctgctgattatgtggggcgctatcggggcattagtcggtgcgggtgtggtattggttcgccgctccaataaggcactgtgacctgtatggccggtgtcatgtggaatcagtaacggcatgtgtcagtaacgactatttgttagtaacgactatgtgtcaataactactctgtgtcagtaacgacacatgatcggccatcgtatgtaatcagtagttgtatgtaatcgatagttgtatgtaatcggtagctgtatgtaatcgatagtcatatgtcgctcgtggttgtatatagttcatagtcgtatgtcgctcatcacggtatgaactcgtatcgagtcacgcactgagcgacaagaaatcgttaatggacgcattgtgcgcccaacttgcaggcattgcctgcggctaactgacctaaagagattcactgtgaaagtgttgactgtttttggcacccgtcctgaagcgataaagatggctcctctggtgcatgccttggctcaggatgacgcctttgaatcgagagtctgcgtaacggcccagcatcgtgagatgctggatcaggtattgcgtttatttgagattcaaccagattatgatttagacatcatgaggccaggacagggattgacggaaataacctgccgcattctggaagggctaaagccggttctcgaagagtttaagccggatgttatcttggtgcatggcgataccacaaccacactgtcggccagtctggccgggttctatcaccgcatacctgtcggccatgtcgaggctgggctgcggaccggggatctctattctccatggccggaggaagctaaccgtcaactgactgggcatcttgccatgtatcattttgcgccgaccgagaattctcgacagaatttgctacgtgaattggtgccggagaaccgtatttttgtcacgggtaatacggtgattgatgcgttgttctgggtccgtgatcgggtgatgaatacccctgatttgcgagcaaacttggcacaacgttacgccttccttgataccaataagaagatgattctggttactggccatcgtcgtgaaagctttggtggtggttttgagcggatttgcagtgcgttagcggaaattgcccggaaacatcccgaggtgcaggttgtttatcccgtgcatcttaaccccaacgtcagcgagccggtaaaccgtatcttgaaggggattgataatattattctgatcgatccgcaagactacctgccatttgtttacctaatgaatcatgcgtatctgatcctgactgactcagggggtattcaggaagaagcgccgtcattgggtaaacctgtcttggtgatgcgtgacaccaccgagcgcccggaagccgtagattctggcactgtgctgctggtggggacaaatattaataaaattgttgatgcagtaacccgcttgctgactgatgagacggcttatcatcaaatgacccgggcacacaatccttacggtgacgggtatgcctgtcaacgcatccttaaagctttaaagaatcatcaggtgacgctatgagttttgaaactatttctgttatcggtcttgggtatattggtctgccgaccgcggcggcttttgcttcgcgtaaaaagaaagtgattggcgttgacgtcaatgcgcatgcggttgaaaccattaatcgtggtgccatccatatcgtggagccagatttagacaaagtggtaaagattgctgttgaaggcggctacctgcaagcggcgacgaaaccacaggcagcggatgcattccttattgccgtaccaacaccgtttaaaggcgatcatgagccggatatgatttttgtcgaatcagccgctaaatccatcgcaccggtgctgaaaaaaggcgatttggtcattttggaatctacctccccggtaggtgctactgagcaaatggcgcaatggctggctgaggctcgccctgatttgagtttcccacagcaagcgggcgaagcagccgatatcaatattgcatactgccctgagcgcgtgttaccgggccaggttatggttgaactgatccagaatgaccgggtgattggtggcatgacaccaaaatgttctgcccgcgccagtgcgttatataaaattttcttggaaggtgagtgtgtggtgactaactcacgcaccgctgagatgtgcaaactgacggaaaacagcttccgtgacgttaacattgcctttgccaacgagttatcactgatttgtgatgagcaaggtatcaatgtgtgggagctgattcgtctggcgaaccgccatccacgcgtgaatatcttacagccgggtccaggtgtaggtggtcactgtatcgccgtcgatccatggtttattgtttctcagaatccacaattggcccgcctgatccacacggcgcgtctggtaaacgacggcaaaccgttgtgggtggttgatcgcgttaaagccgctgttgctgattgtctggccgccagtgataaacgcgcttctgaagtgaaaattgcctgcttcggtctggcttttaaacccgatattgatgacctgcgtgaaagcccagcagtgggtgttgcccgcttgatcgcggagtggcatgtgggtgaaacactggttgttgaacccaatgttgagcaattgccaaaatcactgatgggtcttgtcaccttgaaagataccgccactgctttacaacaggctgatgtcttggtcatgttggtggaccacaaacaattcaaggccatcaaacctgaagatattaagcaacagtggattgttgataccaaaggagtatggcgttgaggcgaattctcgtcacaggcggggccggttttatcggctctgcggtggtcaggcatattattgatggcacctcagatagcgtggtggtggtcgataaactcacctacgccggtaatctggagtcgctgtcagtggttgcgggcagtgagcgttatgctttcgaacaagtcgatatctgtgaccgcagtgagttggatcgggttttcgcacagtatcagccgaatgtggtgatgcatttggctgccgagagccacgttgaccgctcaattgatggccccgccgcgtttatcgagacgaacgtggttggcacttacaccctgttggaagctgcccgtcactattggcaacaactgagtgttgaagccaagcaggcgttccgctttcaccatatctcaacggatgaggtgtatggcgatttacacggcactgacgatttgtttaccgaaaccacgccgtatgcgccaagcagcccatattcggcgtctaaagcgtccagtgaccatttagtccgggcttggttgcgtacttatggtttaccgactttggtgactaattgttcaaataattacggcccgtatcacttcccagaaaagctgatcccgctggttattttaaatgcgttggcgggtaagccgctgcctgtttatggcaatggtgctcaggtccgcgactggttgtatgtagaagaccacgccagagcgttgtatcaggtggttactgagggtgtggtgggtgaaacctacaatatcggcggccataatgagcgcaagaatattgaagtagttgaaaccatttgcgcgctattggatgagttggtgccagcaaaaccggcgggtatcgcacactaccgtgatttgattacctacgtaaaagaccggccgggtcatgatatgcgctatgccattgatgctggcaagattgagcgggaactgggttggcgtccacaagaaaccttcgaaagcggtatccgtaaaacggtcttgtggtatttgaataatgaatcttggtggcgtcgtgttcaggatggctcttacgccggagagcgtttgggcttgagtgactaacacccgccatctttcacgttgtaggtgtattggctgcgctcagtcatccgaataacttactgatgtaagtacctcggggttctcttgcttgctgccttcctgcaccttgaaatctatagtgtctatcgttgggcgatctacgagagacaccaaagtcgattaatcatcgggatggcgtcatccagtcgtttacatgatgttttgcctgtgtatagcctctgcctgatggtctcaggagatggtatgtatcaggaaattgtatgtatcaggagattgtatgtatcaggagaacgtatgaaaggcataattctggctggtggttcaggttcccgattacaccccatcacccgtggcgtctctaagcagttgcttcccatctacgataaacccatgatctattacccgctgtcagtattgatgctggcagggatccgtgacgtgttgattatctcaaccccggaagacttaccatcgtttcagcgtttgttgggcaacggtgatgagtttggtattaatctgagttatgccgcgcagcctagcccagacgggctggcacaggcatttatcattggtgaagcgtttattgataatgagccatgctgtttggtgctcggtgataatatctacttcggccaaggctttagtccaaaactgaaagctgtcgccgcgcgtcagcagggcgcgactgttttcggctatcaggtgatggatccagagcgctttggcgtagtggagtttgatgacaacttccgcgcgttgtctattgaagaaaaaccgagccagccaaaatcaaattgggcggtgaccgggctctatttctacgataaccaagtggttgattttgccaagcaggttaaaccttctgctcgcggtgaactggaaattaccagcattaatcaaatgtatctggatcgcggtgagttaacggttgagctgctagggcgcggttttgcctggctggataccggcacccatgacagcctgatcgaagccagtacttttgttcaaacggttgaaaaacgccaaggttttaaaattgcttgtttggaagagattgcctggcgtaacggttggttggatgatgatggcgtaaaacgtgcggcaaccgcgctggcgaaaaccggttatggcaaatatctgttggatctattacatgcccgtccacgccagtattgagccactgggctgggaaagtgaatttttccagcgccaaagtgcaaaattgattttttccgactcagccccgccacttaacccggctgagttggctgcttttactctcgttcaggctaaagtacctactcatcgccttgatcttatagatgccctgagccaacttgattttcatttggttgaaggggaaattgatctgtcgctggccgtgggtgaaaaagaaggtattggcacggaaaatgctacatcagaacccaatatggggccctactcgcaacgggttgccaccgaggcagatattccgcagttgcgccgtgttgctgccagtacttttgccttaagccgctttcgtgcgccttggtatgacgcacaggacagtgggcgattttatgctttgtgggttgaaaaggcggtgctgggaacctttgatcaccaatgtttattggtgctcgactctacggatcaacccgtcgggtttgtgacgttgcgtgacttgcaagacgggagtgcgcgtattggcctgttggccgtattccccggtgcacagagtaaaggtatagggttaagattaatgtcggcggcgaagcagtggtgccagcatcatgggttacaccggttacgggtagccacacaaatgagcaatattgctgctttacgtctctatattcgtagtggtgcctccattgagagtaccgcgtattggttatgcaggggatgagatgattccatttaacactccaccgatagtgggcactgaactgggttatatgcaggctgcgatgagcagtggcaagttatgcggtgatggtggttttacccgtcgctgccagcagtggatggagaaacgttttaactgcccaaaagtgttactgacgccatcttgtaccgcctcgttggaaatggccgcgttattgctggatatcaagcccggtgatgaagtgatcatgccaagttttacctttgtttccaccgccaatgcctttgtgctgcgcggggccaaaatggtgtttgtcgatatccgtccagacaccatgaatatcgatgaaaccaagattgaagcggcgatcaccgataaaacccgggttattgtgccagtccactacgcaggggttgcctgtgagatggataccatcatggcactggcgaaaaagcataatttgtttgtggtagaagatgcggctcaaggcgtgatgtcaacctacaaaggtaaagctctgggtaccattggccatattggctgcttcagcttccatgaaaccaaaaattacactgcgggcggtgaaggtggggcgacgttgatcaatgatccttcattgattgatcgtgcagaaattatccgtgaaaagggcaccaaccgtagccaattcttccgtggtcaggtggataaatacacctggcgtgacatcggctccagctacttgatgtctgatttacaggccgcttacctgtggggccagttagaggcagcagagcagatcaacgaacgccgtctggcgctatggcatggttattataatgctttcaaaccgttggccgatgctgggcgcattgatttaccggtgatcccaggcaacgtggtgcaaaatgcccacatgttttatattaaactgcgtgatattgaggagcgctctgcatttatcagctatttaaaagaagcggatattatggcggtattccactacatcccattacatgcgtgtccagcaggtgaggcgtttggccgtatggctggcgaagaccgctttacctccaaggagagtgagcgtctggtgcgcttacctattttctacaacctgactgatgttaatcagagcacggttattaatactgtgctgagtttcttcgtctgatatgtctctggcaaaagcatcgatttggactgcctgctctacgctaatcaagattggcgtagggctattggtggttaaactgctggcggtcacctttggccccagcggtgtggggcaggcgggtaatttccgtcagctaattatcgtgttaggtgtgctgtctggcgcgggtatctttaacggtattactaaatatgttgctgaatatcatcagcaacctgaacgtttacgggccatgctgggcacctcgtccactattgttcttgggttctcaaccctattggccttggtttttctgctggccgcgaaacctgtcagcatcgcgttatttggccatgcggattaccagaatgtggtgcgcgcgatagcatttatccagatgggaattgcctacggcaacttgtttctggcgatcctcaaaggttatcgcgatgccatgggcaatgcgctagcgatcattggcggtagcctgattggggtcgtagcatattatatttgttttcagatcgggggctattcgggtgcgttagttggcttaggattagtcccggcgttggttgtgctccccgctgcggcgatgctgtaccgccgccgtacgattccgctgcgctaccttaaaccgcattgggataaagcgctggccagccatttgggcaaattcacactgatggcgctgattacgtcagtgaccttgcctgtggcctatgtaatgatgcgtcacttactggcgaataactatggttgggatgccgtcgggatctggcaaggggtcagcagcatttcagatgcttacctacaatttattacggcctcatttaccgtctatctgttgccaacactgtctcggctgaaggataaaggggcgatttcccgtgaaatcctccgttcactaaagtttgtgttgcctgcggtggcggcagccagtctgacggtttggttattacgtgattttgctatctggttgttgttttctcaccagtttactgcgatgcgtgatctttttgcctggcagttggtgggcgatgtattaaaagtggggtcttatgtgtttggctatctggtcattgctaaagcatcgctacgtttttatattttggcggaagtcagccagttcttactgttgaccgggtttgcctactggttaattccaatgaatggctctcttggtgcggcacaggcgtatatggcaacgtatatcgtctattttgcgctctgtagctgcgcattccttgtgtatcgtagacactcagcaccgtaaacactctttacagtagaaaaaaatgataaccctgactcatgtactgggatctgatatcccgcaccataatctgaccgtgttgcgtttctttaatgacgtgctggcgaaatgcctgcctgtagaacaggtacggcactttatggtcgcggcaaaagaaacggcccccttttcgtcattcccgcagttggatatcaacacgtacagtgataaaaaagcgttggctgaggcggttattgcccgtgcacaggcggatcgcagtgcgcgtttcttttggcacggtcagtttaatgccactctctggttggcgttgctaagcggtaaaattaagccagggcaggtgtattggcatgtctggggtgcggatttatacgaagatgccaaaagcttaaaatttcgtctgttttacctgctgcgccgcatagcacaagggcgggttgggcacgtgtttgccactcggggtgatttaattcattaccagcagcggcatcctcgcgtgcccgcctcattactctacttcccgacccgtatggatccggccctgaccgctatcaatattgataaacccttagctgggccgatgacaatcttggtggggaactccggtgataccactaaccgccatatagaggcgctgaaggcgattcatcagcaatttggccctgacgtccgggtgattattccgatgggctatccggcgaataacgaagcgtatattgaacaggttaggcaggcggggctcgcactgttctcgcaagacaatctacgtatcttaaccgaacagatcccctttgatgattatctgaatattctgcgtgaatgtgatttgggctatttcatttttaaccgtcaacaaggtattggtaccctgtgtttattgacccagtttggcgtgccctttgtgctaagccgtaaaaatccgttctggcaagatttggctgagcagcatattcccgtgttcttctacggtgacactctggacgagccgctgatccgtgaggcacaacgtcaactggcagggttagataaacaagcgatcgctttcttcaatccaaattatattgagggctggaagcaagcgttggctctggcagcgggggaacacccatgacgctggggcaatttggcggtctattttgtatttatttgatagcagtcatttttattctgacactaacttatcaggaatttcggcgggttaagtttaactttaacgttttgttttcaatgctttatctgttgaccttctattttggtttcccactgacttgtatgctggtgtttcagtttggggtggcggtggtgccggttgagtatttgttgtacgccatgctgtctgctacggccttttatggcatttactatgtcacctataaaacacggttacgtcagcctcgtagccagccgcgcacgccaatattcaccatgaaccgggtagaaactaatctgacctgggtgctgctggcactggtcgcggtagggaccgtcggcatcttctttatgcaaaacggtttcttgctgtttaagctggattcctacagcaaaatattctccagtgatgtctctggtgtcgccctgaagcgttttttctacttctttatcccggcaatgctggtggtttatttcctcaagcaggatcggcgggcctggttcttcttccttgccagcacggtggcgtttggcattctaacttatgtcatcgttggtgggacgcgtgccaatatcattatcgcgttctcattgttcctgtttatcggtatcgtccgtggatggataaccctgtggatgctagcggcggcaggtgtcttcgggattgtcggtatgttctggctggcccttaaacgttatggcctggatgtgaacggtgcagaggcattttacaccttcctctatttgacgcgggacaccttctcgccctgggaaaacctcgggttattgctacagaactacgacaaaatagatttccaggggctggcaccgattgtccgtgatttttatgtctttattccaagcgcgctgtggccagaacgcccggatttggtactgaataccgccaattactttacctgggacgttttggacaatcactctgggctggctatctcgccaacgctgattggttctctggtggtcatggggggggtattgtttatcccgctgggggccattgttgtggggcttatcatcaaatggttcgattggttgtatgaacaaggcaaggccgagagtaatcgctataaagcggcgatcctgcaaagcttctgttttggggcggtgtttaatatcattgtcttggcacgtgaagggctggattcctttgtctcacgagtggtatttttctgcgttatctttggtgcctgtctggtactggcaaaattgttgtactggttgttcgatacggcgggcttgataaagcgtcaggggattaaatccaaccgattatcaacgcctaacgcgggcaatcaactgtaaggattgtaatggaacccaatactgtcattccaaaatataatgtccgtggctttgaaatctggggttttcgtgacatggctcaggtgctggatcatctactgggcagtgggccggtaaaaacgggcaccttggtggcgatgaatgcggaaaagctattaaaagccgaagatgatactgcactgtgtgaactgatcaagaacgcggagtatctgtacgcagatggcatcagtatggttcgggctatccgccgtaaatatccgcaggccgagctatcacgcgttgcgggtgctgacctctgggaagccctgatgcagcgcgctgggcagcaagggacgccagtatttttggttggcggtaagcctgatgtattggctgaaaccgaggcgaaattgcgtgcccaatggaacgtgaatttagtcggtagccaagatggctatttcacaccggagcagcgtgaagccctgtttgcccgtattgccgccagtggtgcagcaattgtcactgtcgccatggggtctcctaaacaggagatcttcatgcgtgactgccgtaaattttaccctgatgccctgtatatgggggttggcggcacttacgatgttttcaccggccatgtcaaacgtgcccccaaaatttggcagaatatggggctggagtggttataccggttgctggcgcaacccagccgcattcgtcgtcagcttaagctgcttaagtttgttggttattattatagtggtcgtctgtagtgttttgttcttagtcgcgccccttcttaccttgacgccgcagcggttagcggcgtcactcagttgaatcacttcacttcacttcacttcacttcacttcacttcacttcacttcacagctctgcgtcagttcgtctaactaatttccttatggaatcaattttcttatttttattccataaagttttagtttgctgtttgctaatttacaccaaatacggaacgatacgggccggttacggtttggaggggggatggtcgttctttcctagtggtagtggttcccttcgttaacctacaaaataacaatgaacagactgctgacaaagttaattgaaggggaaacgtgccgttggggtcgtagtggcgtaagccaccggagtgccccgaggtgcggtcaacccttcattcacgaggctaaaaatagctttgtcaataatctcaattaataccttgataaatatattgaatatttaaattcagtcattaaattcatttgcatcataacgataataaccggggattccggagcagatatacaccagtcagtttacagaggatatatggcagacaacgcagagaaaaaaggattacaccgtgggctggaagctcggcatatcgaactgatagcgttgggcggtaccattggtgtcgggttatttatggggtcagcaagcacgttgaaatgggcagggccgtcagtattactggcttatatcattgcgggcttatttgtattcttcattatgcgcgcaatgggggaaatgctgtatctggagcccgtggctggatccttcgcagtctatgcgcataagtatctcagtccctattttggctacctgacggcttggggctactggtttatgtggattgcggtggggatatctgaaattaccgccattggcgtctatgttcagttttggttcccagaaatcccgcaatggctgccggctatcgctggggtggcgattgtggcattagcgaatctggctgcggtcaaattgtatggcgagctagagttttggtttgccatgatcaaggtcacgacgatcattgtgatgattttggttggcttaggcgtgatattttttggcttcggtaatcacggccagccgattggcttcgataacctgaccgcccatggcggtttctttgccggggggtggaaaggcttcctgtttgcgctgtgtattgtggtcgcgtcttaccaaggtgttgaactggtcggtattacggcgggagaagccagaaatccacaggtgacgttaagaagagcgatcaacaacatcttatggcgaattttgattttctacgtcggtgcaatatttgtcattgtcaccatttttccctggaatgggattggtacagagggtagccccttcgtactgaccttcgccaaaataggaatagtggccgcggcgggtattattaacttcgtgatactgaccgccgctctctcaggttgtaacagtggtatgtatagcggcgggcgtatgttgtatgccttggcaaaaaatcgtcagctaccggccggcctgaccaaactgtcggctagcggtgtaccggtgtactgcattgcgatcaccatcctgtgtctactggtggggtcgagcctgaattacattattcccaacccgcagcaagtgtttgtttatgtctacagtgccagcgtgttacctggcatggtgccgtggtttgtggtcttggtctgtcagttacgttttcggcaggtacataaagctgccctacagcagcacccgtttaaatctatcctattcccctatgtgaactacctcaccatcgcattcctgatttgtgtattagtgggaatggggataaacccagatactcgcttatcattactggttggggcaatttttctggcattagtgacgggatgctattttgtgctggggatgcataaacccaaggccatggaagcggaacgcctataaaatcggcaatcaagacggtgtgggggctattattcactgagttttgtggcagagtgagcaaagcgtaagcaaacgcatcatttcttctaaaaaagcactagacagccaggtattaaaaccgtagtatccccacccgcaacggcgctaagcgcccgtagctcagctggatagagcgctgccctccggaggcagaggtctcaggttcgaatcctgtcgggcgcaccattaattttgtgtgcaagagctgcggtggtaagattgccgcgtacgacgatgtaagctgtaagaaaggctgtaaagaagtgatggtggctatagctcagttggtagagccctggattgtgattccagttgtcgtgggttcgagtcccattagccaccccaaatttttgtggaacatgcgatggtggcggaattggtagacgcgctagcttcaggtgttagtgtccttacggacgtgagggttcaagtccctcccttcgcaccacacaaacatgtagatatttattaatatttacatggacataggtcgagagaccatgtagagtaagcagcaagaaatcggcgagtagcgcagcttggtagcgcaactggtttgggaccagtgggtcggaggttcgaatcctctctcgccgaccaatttcagaagaaaccccgcaatgcggggttttttttcgcctgaatataatgattctattttgccagaccgacagaccgacagaccgacagaccgacagaccgacagaccgacagaccgacagaccgacagaccgacagaccgacagaccgacctgcaactttcccccctttattcgccgtatcctccgcgccacaggtactttgttaatcacctccattattagctccctttgatcgcattctgctgccagtaccgttagctgggctgtttcgttgtgttgggcgtcagtgttggttttccacgacaataaacgatcacattgtcgtgagaaggtgacatttaattcattgaaaaatatattaaaaatcaatgtagggttataacgtcgttttgtagcgacagttcactctggtcaccgggatatcactcggttagccgatggggatgaatgaaatgcagtcaaaaaaataaacttattatttatcaagttattagtgatttttggggaggtgtttgaggtaaagggcctgtctgctgccagatctggcacgctaagtgcaatatctaacctgtagatgctcatcccacttattatgacagcttggccattaaggctaatttagcttcataaacccagggatgacgcagagccgattttagagtgcctattgtccatgtaaccgatgttgagtaatgtcatcacataccgggcataacgttgagtgaggcactgatattgttgtctatcgacctgaaaattttagacacttgcccttttcggcaagtgttttttttttgggtgcgcttcgcacttcaagcagcatgtgttggctacggtcgttacttggcccgtccatgggcctcatctgcgggctaacatcaatgtattaatttggttagagcggatgattcgccattctggcgcagggtcagtaataacccctcacgacgcgcttgagcggcatcctcagggcgatgcagtttatccaaggcatccgccagccacgcgtaatcatagccatcaggccgctgcgcaagcgctgctttaaaggcttcgctggctttctcccattcaccgtgtttcagcatcaactgacccaaggtactattgagtaacggtgtggcaccatgctgcttgatttgctggcgcaaagacttttccaacggctctgggttacctgccttcagacgcgggatcaacagcaccagacgttcatcatattggtgtttcaggctgtccagaatgatcttttgggccacatcatgatcatcacattcaatcagatgctctgctaatgcgacctgtaatgggatctcatttcgtactttgcggctttgatctttccaccagcgtttcagaccttcgctgccttcgtccgccatgcactgattcatgatgccaatataggcttgttgctcaagggccgcgacttcttcaggggtgtggatctgtgttttactcatcgccggtaaaatgtccagtaatgagcgataagcaccggagcgcaggtaagcctgttcagccagacgcaggacttctggatgccgtggcgcttgatccaacaagcgatcaacaccgtggcgggcggcatgaatatgcccctgcgccagttgaatacgcactctggtgatattcaccggcagttggtcgccatcggcaacttctgccgcgcgctccagatattgattggtacgaaactcatctccacgttgctgggcggcttcggctgccagcaggtagttaaccatgggttgttccgcgtggtcagcattgcgggtgaggagcttttcaacttgcagaaaatcaccttcagccagcttaatcaacgccgctttcatctggttacgggcgcgggtacgtttacggccaaggaaccagccacgagtgcgggcacctgtgcggaaaatacggcgtagtacccattcaacaataaagaaagccaccaataacaggaccagcatgatggctaacccggtcacactggttgtaacgttatagttgtcagtctggatcagcacataaccctgatgtccggccaacattgggccaagcacgatacccacagttaaaacaaggaataacagcaagactcgcagcatatttattccccctgagcatcaactggcgtttgtgccagtaagttacggaccctggtttgcatcaatttttccagtattggctggcttttcaattgatccggcacgtccattgagataggttgctggcttagattttccagctcatccaagaacgccttggtactcgggtcgttcacatcaaaataagcgcggacccacgtagaaatcgtttccaatgactgcttataaacttcgtcttgatggcgggggactgcctgagcggcaaccagcaggcgggagcgaatattttctcgcagatacacgtcctgattcggtgccagcaaaggttccgcgctactatcacggcggcgaatactaatgaaatcagacataaagctgcgccagcttttactcagattctgacgccattcagagagtgaactggagagttcgtcactgttggcatccatgggagagtcatcaatattgttatcggccaaacgcaagttatccacttgattagacaactggtttaacttgaggataataccgtcaaaatccacctgactgacggcagagagtgcgctgatatcttctgtaatcgcgcggcggacatcgataagacttgggtcattcatatcggccagactggcatcggcgcttttcagtaaggtgaccgcggtggtgacatcttgatcactccacagcttgcgcccggccatttttaccaggaaatcggcctgagccagcagccaggttttggcatcgctgcctgaaatagtcgcgactttttcttgtaattcattgagctggcgtgtcagagaggcttgttgattttctgccgactccagcgctttcccctgctgttgcagtaaggactccagttgctgtttttcctgcaatagcgtctgttttagtgccactaactgctcttgtagcgcaatattctccgcactctgtaactgggcctgctgctgtccatgataataaagccccgctcccagtgctattaccaaggcgatagcgataacacccagaattgggccagtccgtttttcacggtggccttttggttctggctgttggggcctctcaaccgcagtggttggctcttccactggtgcggatggggtattttgttccgtcatattgggcatcccataagtcaggttttaggtttattgaaggtcttgtaacgcacggatcagtgcgtcattatcggcattttctgctacccggacctccgtccaccccatttgggtggctaaggccgctaaacgatcactcacaacgattaaacggcaacgtagtaaccaggaagaacgatagtaatcaggaactaaagtatagatctgttgtaacatttcgccgctggtgaccaccagaatatcaacaccggcacgttgccagtgagcactttgttcgctgccatcataatagatgggactgcgttgatagcattcgcagaaggtcacggccgctccgcgttctgcgaggcttgcgcctagcaactcccggcctccattaccgcgcaataacagtgcctttttaccggccaaattttgcagcaggggcaatgatagcagcatttcacttgtctcccccattggtgggaaagtgacatgcaaacggctggcggtatgcagtgctaatgcggttgtacggccaatagcataataagataactgcacaggccatgacagtttatttctttttaacagcgggttagcgtagcggaccgcgttctgtgataaagcaaaaaccaagtctcccgcccgcatatcttgcagtaattccggcagtttgggcagatctcttcctggggaaaaatcaatcaatggcgcatggtaggcaacccggcccagagcacgcagacgagtgactaattgctccccagcaggggatggacgggtgaccaggattgtcatcgcgcaggattatccagataaaccgccgccaggatttctcgtgcgccgcgtgatagcaactcatcggcaagttcaatgcccatctgctcagcctctgccgccggaccacggcgttcaccccggatcatttggctgccatcaggtgctcccaccagcgcccgtagccataaagtatcaccttccagttcagcgtagctaccgatcgggacttggcaacccccttcaaggcgaatattcattgcccgctccgcacagacccgtaattcggtgtgccgatggttcaacggagccagcaactggcgggtatggtcatcatccagacggcattcgatacctacggcaccttggccgacagcaggcagggactcctccgctgacatggcatagcgaattcgggtttccagaccgaggcgcttgagacccgcgacagccagaataatggcctgatagtcaccattatccagtttggcaaggcgggtaccgacgttaccccgtagatcgcggataatcaggtctggtcgccgttcgcgtagctgacactggcggcgcaggctggaggtaccgacaacactgcctgcagggagatcatccagatgggcataatgtgacgagacgaaagcatcacgcgggtcttcacgttcacaaatcgcgactaaacccagcccttcggggaaagcgatgggcacatctttcatcgaatgcacggcaatatcagctctgccgtccagcagcgccagctctaattctttgacaaataaacccttaccaccgactttggccaatggtgtatccaaaatgatatccccacgggtgaccattgggaccagttcgatttgcagaccagggtgattggcttgcaataaatgttgaacataatgtgcttgccataaggcgagcgggctttgtcgtgtggcaattcgaataattttgtctaacatgcttgttaccgttttatattttacggcccatcctatcactgaccggtgaacactgtcagtgtaatagccgtatgaacagggcggataaatgcctaaaaaaacaactgttgcaatgaatacagcgattgtaatggatgcatgactgcaacaaatgtatgtctgtaacaaatgagtgattgtaacaaatatgtgatgagatgagtgggtgaaccccgtttctttatgctgctgcgcggtgatcagcgcttatgactccgagaaactcattggagccagtgattcgggcataaagaggctttacaatggtagagatagctttactttctttacggttaatcggcaaggtgttagattgatcacgtttccagcaataattcgctaaatattcttcaaataaaatgttttttgtgtttttcaacaaaagacgcaaagcaataagcgaatttggagcacgggcttttttccagacaccggaataatcaggcgagacgtcttgtacctctacatcgagacactgaaacagcgactggatgcgatcaaccaattacgagtcgatcgcgctttggcggccatgggtccagccttccaaaaggtctacagtctgctaccgatcctactacattgtcatcatccgcagatgccgggctaccttgatggtaacgttccccatggcgtctgtcttttcacacctaatgaaatacaacaagattatcttgctgacgttgaagctcggtggggcgaacctctggcaccaagtgcggggggcgaactgccgattaccggcgtctattccatggggagcacctcctctattgggcagtgccacacatcggatttagacatctgggtgtgccaccaggcttggttggatactgaagagcgtaatcaactccagcaaaaatgtagcctgttggaaaagtgggcggcatcaatgggggtcgaggtcagcttcttcctggttgatgaaaaccgcttccgccataatgccagtggcagcttggggggggaggattgcggctcgactcaacatatcctgttattggatgaattttaccgtagcgcggttcgcctggcagggaaacgtattctgtggaatatggtcccggttaaagaagaagagcattacgatgattacgtgctgtcactttatgcgcaaggtgtactgacgccgaacgaatggctcgatctgggcggtttaagcacgctatcagcagaagagtatttcggtgccagtttgtggcaactgtataaaagtatcgattcgccatataaagcggtgcttaaaacattgttgttggaagcctattcttgggaataccccaactcccaactgctggcgatggaaatcaaacaacacttgcacgccggcgaaattgtctcgtttggtcttgatgcttactgcatgatgcttgatcgtgttacccgttatttgatccaaattaatgacaccacgcgtttaaacctggtgcgtcgctgcttctacctgaaagtgtgtgagaaactgtcgcggacaccagccagtacgggttggcggcgtgaggttctcagccaattggtgagtgagtggggttggagcaatgaaaaactggcggtgctggataatcgtgccaactggaagatcgaacgggtgcgtgaagcgcataacgaattattagatgcgatgatgcagagctaccgtaatttgatccgctttgctcgccgtaataatctgagtgtcagtgccagcccacaggatatcggcgtcttgacccgtaagttatatgcggcgtttgaagcgttgccgggtaaagtcacattggttaacccgcaaatttcacccgatttatcggaagagcatctgacatttattcatgtccctgctggccgcgctaaccgccctggctggtatctgtataatcaagctccgtcaatggatgctattgtcagccatcaaccgcttgaatataaccgctatctgaacaaactggtctcttgggcttatttcaatggcttattgaccagtaaaacgcacctgcatattaaaagcgccaatctgtgtgatacggtcaagttgcaggaactggtgaccgacatttcacatcacttcccgctgcgcttagctgcaccaacgccgaaagcgctgtacagtccgtgtgaaattcgccatttggcgattatcgtcaatttggaacatgatccaacgaccaccttccgtaatcaggtggtgcattttgatttccgtaaactggatgtgttcagttttggtgagcagcagcagtgtctggtgggcagtatcgatttgttgtatcgcaactcatggaatgaagtgcgcaccttgcatttcagcggtgagcaggcggtactggaagcgctgaaaaccattttaggcaaaatgcatcaggacgctgcgccaccggaatcagtggatgtgttctgctacagccagcatttacgcggtttgatccgcacccgtattcagcaattggtgtctgaatgtattgacctgcgcttgtccagtactcgtcaggaaccgggccgttttaaagcggtacgggtttccggccagacgtggggcttgttcttcgaacgtttgagtgtctcggtacaaaagttggaaaatgccgttgaattttacggtgcgatttccaataacaaattgcacgggttatcggttcaggtcgcaaccaaccaaattcatttgccgccagtggttgatggttttgccagcgaagggattattcagttctttttcgaaggcactgccgatgaaaaaggcttcaatatttatatcttggatgaagcaaaccgggttgaggtttatcaccattgcgagggcagtaaagaagagttggtgcgggatgtcagccggttctattcgtcttctcacgatcgctttacttatggctccagctttatcaactttaacctgccgcagttctaccaaattgtgcagttagatggccgcactcaggtgatcccgttccgcagcaatacgttatcgcagttgtgcgccaatattgccgaaaaagaagccagcttaccgaccaaacaatgccagttgcattgatatgctgacaagcgaatagccaataaaaacaggttttattggctatctctaataagaaagagagaagattgacgctggtagcaatgagagttatttatattcgttttcgaatgcttcgaactcatcatttttttattatgctccagggatgcagctaatatatccacgtccagttttatgacaggctcgtcttttgacattatcaataattcttcttgattttctggccgtgtctttctataaatatttacagttaattctcttttttcaatagcggtgaagacttcatcaaaattattctgcatgaagagtaaatgtcttttatcaacaggttcgttgagataaagatagtgagacatagaattcaaggctgaaaacggtaactgacctaaatgtatagagaaacaatcacggattatctgacttactcgaccattagcatttggcaataggtgaaggtattgaaagtctgatgttaatttaagagcctgtccataattctgtgtaactgccaccgtattaaaggtgatcgctcaggcggtcaccgaactcgataataaaacggctcatcgctaaccgccagttctggatcggcatactccatttttttgatgcatccttgatcgccaaataaacaaccttccgcactgagtcgtctgtcgggaacactttgcgctttttaatggctgcacggatcacgctgttcaccgattcgatggcattcgtggtgtagatagccttgcggatatcgggcggatagccgaagaatgtattgagattttcccagtgcgtacgccaacttttgctaatttgcgggtatttgtcgtcccaggcctccgcaaacttatccagcgccatcagcgccgcctcttctgtcggagcctgatacaccattttcaaaccgctggtgacggctttatagtccttccatgacacatatttcaggctgttgcgtaccatatggatgatgcacagctggatgtgagtctgcggataaacactgtttatcgcatccgggaaccccttcaggccatccacgcaggcaatcagaatgtcctgaagaccgcgatttttcagctctgtcagcacacttagccagaacttcgcaccttcattttctgccagccacatgcccagcagctctttctgaccttcagtgttgatgcccagcgctaggaacactgctttgtttatcacgctaccgttctggcggacttttacgacaatgcagtccatataaacaatgggatacagagcatccagttggcggttttgccattcagcaacctgctcttttacggcatcggtgactttagatatcagcgtgggagacacatcggcgtcatacatctctttgaaggtggcgacgatttcgcgggtggtcatgcctttggcgtacagggacaaaatctggctgtccatctgtgtgatacgcgtctgatttttctttatcagctgcggttcaaaggtgttttcgcggtcgcgtggcgtattcagctcgatttcgccgtcgtcgcatagcagtgttttggacgaatagccgttgcgggtattcgagcctgatttaggggtatttttctcgtgcccgaggtgttcggtaagctctgcatttaacgctgtttcgacggtaagctttgtcagcatacgagaaaatgcattaaggtcggcttcggttttaagacctttagccagttcagccgcaagtgctttaagtttcttttcgtccataatttgcctgtctccgttgttggagtgaagatatcaaaaacaggcaattacacaatattgtttacagtctctaatttaaatatttcaacaatatcattttttgcatgagcactaactaatttatttgaaaattcataaaggattttatttttattttcaatggtattatcaataacgccattaaatgttacttcgccatttgtatcaattgttaaaccgatatcatatttcaacgcgttgagtgttaattttcctttttctatctccttatgtaatgttttaaatttatagatttggctgttatgcaccctaaaataggatgttaaattttcgatgcataaagtattactacctagtagtatctcaattaatttttcaattcctagtgctatgttttttactctttccgcatggcattgattttcattaggcgttaatgcgttattgagcgtagagagtaagctggtgtatccttctatcataaggacattatcattttcttctgtagcagaataacctttatctttttcacgatatgccattacgggatttagtcgatgtgctgcttcaacatacaaacaagggagtagtatttgtaactgtttgttatctaaattatgaaaacgttgttgtattttattttttacatcaagtacttctttgaatttttcaattttatctatttctttatagccatcgttataattttctattatctccacgtttttctctagcatcttatattgctctggagcagtgagaggaagtaagtggatatcatcaagctctatactgatatctgtaatgtcagtattttcccagtggatattgttgagtttcgcattgcaaataaacgctttttttaaatttgtatttgtcatgtttgtatcactaagatcagtgaaatctaactcagctccggataaattaagattacttaaatccacccctctaaaatccatacctgaaaacattagtgttgtggaagcagtattatcttcacatatgttttctaacactgctctttttaatctctgaaggtcgtgttgatctgcctgactgacatcttttgatatttttttcattaatattgcaaaacccttttcctcatcgtcaaggaaggtatttttaccaggttcactatttggtatcgagtagacattgctgggtgaggatagggggcccatgaattttcctataattaagaatgaataataattttggctgagtgttactttgtaacaagggagattgtttccttatttatgcttataagtaatcgggtgttgaccggactttttagatgccgaaaggatatatttagcgtgttccaattgaataccaaccgagttgctcggctggtattgcgattttactcactgaaactgacttcttcacccgcctgtgtggtcgccgcttcggacaatttagcaaaaaattcttcgccactgcgtgagcaataccagtggccgtcacgataattaaagtggtagccgcccgctttggtcgccagccatacctgatgtaagggctcctgacggttgatcacaatcttgctgccattctcgaaggtcagggtcatcaccccgccattggtttcataatcgatatcactatcgccagtaaaaccatccagtgtctcttcaatgtaaagcatcaattgatcggctaactgatgaaactcgctgtcgttcatattcgattcctattgcttttcatgatccacctgcgattatagagagcttggacgcatgagtgacaggtttaatgcgctttaacaggttttcaatgcgctttacagtttcaatacactttacaggtttaagacaatttacaggcgttaaaaaatgaaaaaagaactacgttggccaatggctgcaatgatggtacttgcacttgctggttgtggcctgaaaggcccgttatactttccaccggcggataaacctccggtcgatgcagcgccaccagagagtgggcaggtagagaaaacccaacaggatctgtctgctacaccacagaccccctctactgccgagtcgcagtgatccgaaaccctgggtttgataccttcgcggtgtatgatctgcaagacattaggctagggcgagcatgaacaccgtcacatgacatcagtactgatgccagccctgtatcgacgttagccaacaccgaatttagccaacaataaaaagagtagtcagcggagtatgatatgcagttctccaaaatgcacggtcttggcaacgactttatggttgttgatgcagtgactcaaaatgtttacttttcgccggaattgatccgccgattagcagaccggcacacgggtgtgggctttgatcagatgctggtagttgagccgccctacgaccccgagctggattttcactaccgtatttttaatgccgatgggagtgaagtctcccagtgtggtaatggcgcacgctgctttgcccgttttgttcgtttgaaagggctgaccaataagcgcgagatcagcgtcagtacgcaaactggccgtatgatcctaagcgtgacagaagatgaacaggtttgcgtcaatatgggcgagcctgattttgaaccgcaaactgtcccttttcgcgccgccaaagcggagaaaacctatattttacgcgccgcagagcatacggtgctgtgtggcgtggtgtcgatgggcaacccccactgtgtgatgcaggtcgatgatgtttcggttgccaacgtggcgttgctcggtccagtattggaaaaccacgagcgtttccctgagcgggcaaatatcggctttatgcaggtcgtcagtcgcgaccacattcgtttacgggtgtatgagcgtggggccggtgaaacacaagcctgtggcagtggtgcatgtgctgcggtggccgtcggggtggtgcaagacttattgaacgaaaatgtgcatgtcgaattgccgggcggcagtttacacatccgttggcaggggccaggccatccgttgtatatgaccgggcctgccacccatgtctatgacggatttattcatttatgacgagtgttgatacatggcgagcgttaatatatgaagggcagtgatacatgaagggcgttgatatatgaagaattatgaggagcaggcgttagcgggcatcgaattagacgatgatgctgtgatgcagtacttattgcaaaatcccgacttctttatccgcaatgcccgtctggtcgagcagatgcatatcccccatccggtcagaggcagtgtctcgctggtggagtggcagctaggacgccagcgtaatcagatcggccagttggaagaggagattaccttgctgatggagcaggcgggattgaatgaagtgttgttcagccgtttgttacaattgcaagccaatctggcggcggcggatagcttgcaagatatgctcaatcgtctgcaacgttgggccagagatttcgggttggctggtgctaacattcggttattcagtgaccgttggcagattggcgcaccctctgattttacccatttggcgctatcccgccacgcgttcgaaccactgcgtattcagcggttaggtaaccgccaccattatctgggtagcctgaatgggccagaattattgctactcttgcctcaggccaagctggtggggtctgtcgcgctgtcgttattgggcgcggacggcgatttgggtgtcgttattttcagtagccgcgatgctcagcattatcaacaaggtatggggacggtgatgttaaaccagctatccacattgcttccgggcctcctggcacgttggatcgagccggtatgaccgagttcagtgcttcactggctccgcaggtagaggcttttctccgttatctcagtattgagcgtcagcttagtccactgaccgtcaccagttatcgccgtcagttgtctgcgctaatggaaataggcgaacagatgggcttggctcactggcagacgctggatgctgctcaggtccgttcgttggtctcccgcagcaaacgtacgggtttacatgcttcaagcctggcattacggctctccgcattacgcagttttctcaactggttggtcagccagggcgtgctgccagccaaccccgctaaaggggtcagtacgccacgctcgggccgccacctgccaaaaaatattgatgttgatgaaatcaataaactgctgagtattgatctgaatgatccgctggcggtacgtgaccgggccatgctggaggtgatgtacggcgcggggctgcgtttatctgaattggttggcatgaactgtaaacatgtggatctggcgagcggcgatgtctgggtgatggggaagggcagtaaagagcgcaaggtgccgttaggtaaaacggcggtgacctggttacagcattggctggcgttacgtgagttattcgaaccgcaagatgacgctatttttctggccaataccggcaagcgtatttcagcccgtaatgtgcagaagcgctttgccgaatggggggtgaagcagggggtcagtagccacattcacccacataaattacgtcactcttttgccacgcacatgctggaatccagtggtgatctacgcgcagtacaagagctactgggccatgccaacctgaccaccacgcaaatttatacacatctcgactttcaacatctggcgacagtgtatgatgctgctcatccacgggccaaacgaggcaaatcctgatgcatttttatcgtccacttgagcgtatttccgctattaccttcgatttggatgacacgttgtacgacaatcggccagtgatcgcgcggactgaacagcagtctgtggcttttttacaacagtatcatcccaatttagccctattacagccagtggatttccagcgcttacgtgctgaattattggcacaagatcccggtatctaccacgatgtcacgcaatggcgctggcaggcgattgaactgggcttgatgcgccatggcctgagtaaggcagaggcgcaagcgggagcggatgcggcgatggcaaacttcgcgctatggcgcagccgtattgatgtgccgcaagccacacacgatacactgagcgcattggcggagcattacccgctggtggccatcactaacggcaatgctgatcctaaagcttgcgggttggatcgctattttcaatttgtcttacgctctgggcctcatggccgcgccaagccattccgcgatatgtatcataaagcggcgaaccatttggatattccgttaaaacatattctgcatgttggcgatgacctaacgacggatgttgccggctcactgcgctgtggtatgcaagcctgttggattaacgataggcaacaaaacctgatgactgcccgtgatagccgtttactgccacatattgaaatttcccagttggcatccctgacagcattgctataatcctcagcaataaccctgtgtaaatctacagtgggagggggcaaacaaccggagacccggcattgtggctattttcccttacccaataaacggtgcctatggacgtttctgatctgctcgacagcctgaatgaaaaacaacgtgacgccgtggccgcgccgcgcggcaacttgttggtactggccggtgcaggcagtggcaaaacgcgggtgctggttcaccgtatcgcctggctgttgtcggtagagaatgcctcgccgtattcgattatctcggtaacctttaccaataaagcggcggctgaaatgcgccaccgtattgaacatctgattggcaccagccaaggcgggatgtggatcgggactttccacggtttggcgcaccgtctgctgcgtgctcaccatctggatgccaatctgccacaagattttcaaatcctggatagcgatgaccaactgaggttattgaaacgcctggtcaaagcactcaatttggatgagaaacaatggcccccgcgtcaggcgatgtggtacatcaacggcaaaaaagacgaagggctgcgcccacaacatattgagagctacggtaatccggttgaggccacctggctacgtatctatcaggcttatcaggaagcgtgcgaccgcgcgggtctggttgattttgccgagctgttgctacgagcgcacgagctgtggctgaacaaaccacatattcttaatcattatcgtgaacgctttaccaatattttggtggatgagtttcaggataccaacaacatccaatatgcctggatccgcttgttggccggtgaacgttccaatgtgatgatcgtcggcgacgatgaccagtcaatctatggttggcgcggcgcgcaggtcgagaatatccaacgtttcttgaaggatttccccggtgcggagaccatccgcctggagcagaattaccgctcgaccagcatcattctggctgccgccaatgccctgattgccaacaatgacggccgcatgggtaaaaatctgtggaccgatggcgcggagggcgaacctatctccctctattgtgcgtttaacgagttagatgaagcccgttttgtggtcaatcgtatcaaagcctggcaggacaacggcggtgcgctgaatgattgtgccattttgtaccgtagcaacgcccaatcgcgcgtattagaagaagcgttactgcaaacggcaaccccgtaccgtatttatggggggcagcgcttcttcgaccgccaggaaattaaagactcactggcttatctgcgcctgatttccaatcgtaatgacgacgccgcgtttgaacgggtggtgaatacacccactcgggggattggcgatcgcacattggatgtggtgcgtcaaaccgcccgtgaccgccagttaacgctatggcaatcaacccgtgccatgttgcaggaaaaagtgctggcagggcgtgccgcgtccgcattacaacgctttgtcgagctgatcgattcactggcgcgcgaaacggctgatatgccgctacacgtgcaaactgatcgcgttattcgtgattctggcttgtggtcgatgtacgaacaggaaaaaggcgagaaaggtcaggcacgtatcgagaaccttgaagagctggttacggcgacccgtcaatacagctatcaggatgaagatcaggatctgatgccgctacaggccttcttatcccatgcggcactggaagccggagatggccaggccgatgcctatcaggatgcggtgcaattaatgactctccattcagcgaaaggcttggagtttccacaggtatttattgtgggaatggaagaagggatgttcccgagccaaatgtcattggatgagggggggcgtttggaagaggagcggcgtttggcctacgtggggttaacccgtgcgatgcagaaactgacgttatgttacgccgaaagccgccgcctatacggtaaagaggtcaatcaccgcccttcacgctttatcggcgaactgccgcaggagtgcgtcgaagaggtccggctgcgcgccagtgtttcccgcccggtgaatcaccgccgaatggggactccgatgcacgagaatgacagcggtttctcattgggccagcgagtgcggcaccctaaatttggcgagggtactattgtgaatttggaaggcagtggtgagcacaaccggttgcaggttgccttccccggagaggggattaagtggctggtcgcggcctatgcgcgtctggaacccgtgtaatctgatatttgtggtggttgcagtgtcagtgcggccacctatctatttttatttctccttactatctttattgctccttactattttcattgttcttactgttttcattattttcacgaatgagttttgtcctgagccgccagttgggaatcggtttcagcttgcaacaaaatggccttgcccatccactgggttacatcctgaatccccgcttcgtccagatgccaaatatctttcagcaccataaaaacttcagagccatagattaatgaaaaggcatggatcacccgttgcaaggcctctggtgccaacgtctcttccagtggctcgacggccaatttcagtaatcgtttacggttcccacggattaacttctcttcattgctgctgttattactgtcactgctgcgggcatcagcccattgctgtagtgataagtgcagcgctgcacgtaacacgccttcatgttgcaacatgcgcggataagcaaaggacaataattcggcgatacgctgccgtgcatccggttgggtgggttgccaagccaatattggaccgaggctctcatcgaccatggctgaaaccaatgcgctttgtgtcggaaagtaacggtaagcagtagcacgagaaagctgagccgcactggcgacttcggtgattgatgggaatgcaccacgttcatacatcgacatggcggtatcaataagtaaccgccgggttctggctctaatggtcgttaacgatggagagaaaccttcttgtttattctgagtattcacggttgctccatggtttatagacttaatgagtttgatgatctaatgaatttatagagttaatgagtttacatgccacattcgtatactgattatatctgcttcactataccaaaccgctagcacaaatcactatccatgcgtttcactcttacatgaattttgagactatagtctcatattctgcatgtgctctttgcgataatgatactgctgtctcaatatggtgctatcttaatcattcggtgctgtcggttgatccataaaacgcatcgcttgagctataaaaaatattacttgagccataaaaaatatcagttaccccataagaaatgtcacctaaaaaataagccgttataaataagcatgttgaaaccgataggtggcaacaggaaatgagtcgccaccacattcatagaaggatgttcagatgcctcgtcatatttatattgctaccactaccgataccaaaggccaggaactggcgtatgtcagtgaactgatccaggcaaccggtctgacaacagtcacggttgatttatcaaccaaagagagccaaagggatagcggtgctgatatttgcgctgaaacggtggcgggctatcaccccgatggtcgtcaggcggttttttgtggtgatagagggcaggccattaatgctatggctatcgctttcgagcgttttatggtgagtcgcgttgatgttgccgctttacttggtatgggcggctctggtggtacagcgctgatcaccccagcgatgcaacgtttacccatcggtatccctaaactgatggtgtccaccatggcttctggtgatgtttccggttatatcggggccagtgatatcgcgatgatgtattccgtcaccgacattgccgggcttaaccgtatttcccggcgggtcctcagtaacgcggctcaccaagttgcgggggcggtttattttgctcaagaagcgtctccggttgatgacaaacccgcgctgggcctgactatgtttggggtgacaacaccgtgtattcaggcggttagcgcagaattatcggatgaatatgactgtttggtattccacgccacgggcagcggtggcaaagcgatggagaaattggccgaaagcggtttattggctggcgtgcttgacctgaccaccacagaggtttgcgacctgttatttgatggcgtattagcctgtgggccggaacggtttgatgcgatagcccatacccatattccctacgtcggttcctgtggagcactggatatggtcaattttggcagcccggccaccatcccggctaaatatgccgaccgcctgttctataaacataatgctcaggtgacgctgatgcgtaccactgagcaagaaaacattgaaatggcccgctggattggcgagaagttaaaccgttgtcagggtgaagtgcgctttttaattccggaaggggggttctccgcattggatgcccccggtcaaccgttctgggatgaaaaggcgctaacggcctttatccgcacactggaagaaacggtgattcaaaccgataagcggcgcgtggtccattatccattcaatattaatgacccgctgtttgctcaggctgccatcgaaaactttaaagaaattgtgaataaagaaattgtgaatcgtccttcccattaggggcattttatttatggagaagcacatgcctaaatttcaacgtcaggccatattggccaagtttcgggaaatgattgcccgccgtgaacctattattggtggcggtgcgggtacggggctatcagccaaatgtgaagaggccgggggaattgatttaatcgttatttataactcaggccgctatcgtatggctggtcgtggctcattggcggggttactggcgtacggcaatgccaatgacattgtggttgatatggcaaaagaagtgctgccggtggtcaagaataccccggttctggccggtgttaatgggacagaccccttctgccaatttgatcactttttggaccatctgaaagcgcttggtttttcaggcgtacagaacttccccactgtggggttaatcgacgggaatttccgcgctaaccttgaagaaacgggtatgggctatgggttggaagtggaaatgatccgtttggctcaccaaaaagatttactgaccacgccctatgtcttcagtgccgaagatgctatcgcgatgacacaagcgggtgccgatattattgtgccgcacatggggttgaccactgggggcaacattggtgcggatacggcactgaagctggccgactgcgttcctctgattaatgattgggcagcggcagccaaaagcgtccgtgaagaggtgattgtgctgtgccatggcgggccaatctctacaccggaagatgcgcaatacattatggatcattgcccacaatgtgatggtttctacggcgctagctcaatggagcgtttaccgacagaaattgccctgactgacaccacccaaaaatttaaaaatataacgcgttgatactttttgccaataccagtggaaagcctgctttgtgagttttgtccggtaatcggctaaatgaagatgcaggatacgcaaaaccgaagttgttactgacttcggtttttttttgggtcttttagcgcgaatagcccccattcaaagactcgaaatgcgagacctcgccagcctattacggcgctcgactgacctctagtcagtgagccagtggtgagatcaccaacagtaactggctgataaaattcgtattataagcagacgatgagcggctctttggcgagtgtggcaagccatgctgtctaacaatcaattttatcggcaacaactgcaaatagtgctcataaattaactacttttaaccggttgacagtctttttcttctcggcgtaacatgcgcgcactattctttatgaggaccttcgccttggacacacccagtagatactggctcaataacctattcatagggtgcaacttctaaggctatcctcttttttgctgatagccttcgtggttgtcagcggccccgctaaattgtcgctgtgagtcaggtcttttatggtctgaaacataggtatttcgatattcacctgtttctgtgcttcaatgcgtatccctatccatcaccgcaagggagttttggcacatgctgagcgcatttaaattacacaacaatcgcttatctcgcttggagctggatgaatcagatgatctggcctcctcactgtgggtcgatctcgttgaaccggaagaaggtgagcgggagcgcgtccagacggagttaggccaaagcctggcgacacggccagagttggacgatatcgaggcttcggcccgtttttttgaagatgaagatggtctgcacattcactccttcttctattacgaagatgctgatgatcatgcgggtaactcgaccgtggcatttactattcgtgatggtcgcctttacaccctgcgtgagcgtgaattgccggcgtttcgtttgtatcgtatgcgcgcacgtaaccaaacgttagttgatggcaacgcttatgagctactgctggatctgtttgaaactaaaattgagcagttggcagatgaaattgagaatatttacagcgatttggaagccttaagccgcgtcattatggaaggccagcagggcgatgaatacgatgccgccttgtccacgttggcagagcaagaggatatcggctggaaagtgcgtttgtgtctgatggatacccaacgggcgctgaatttcttggtacgtaaagcccgcctgcccagcagccagttagagcaggcacgcgaggttttgcgcgatatcgaatccttgctgccacacaatgagtccctgttccagaaggttaacttcctgatgcaggctgcgatgggttttatcaatatcgaacagaaccgcatcatcaagatcttctcggtggtttctgtggtcttcctgccgccaacgttggtggcatcgagctatgggatgaactttgagtttatgccagagctacgttggtcatttggttatccgggggccattgctctgatgatcattgctggtctggctccttacctgtacttcaaacgtaaaaactggctctagggttgtattgataaaaatatccagcaacgaataaaaaagcccggtcactcaattggactaaccccaatattgagtaaccgggctttttttcggcatcttaccggcgtagtttgcgttgggtatagagtgcatccagcgtaaacagtagcagggcggcccagataaagatgaaggtcaccatcttgtcattaccaatggtttcaccgtagaacgtcactgccaaaataaacatcaatgttggcccaagatactggaagaaacccagtgtcgaaagacgcaaacgggtggccgccgcggtgaagaacagcagtgggattgtggtaatgacgcccgcagcggctagcagcaggttcagcgaccaggcattggcgctcaggtggctggtcgggctgtcggcgatgaaaaacagatatacggcggctactggtagcagccacatggtttcaatgagcataccggtttgggcatcaacgcccagctttttacgcaacaagccgtataaagcaaaggtgatggccagacccagcccaatcactggcagtgaaccaaattgccacagttgaatcagcacgccggcaaaggcgagtgccacggcgacccattgcatacgacgaaagcgttcgccgagaaataacatgccaaacagcacattgaccaacggattaatgaaatatcccagactggcttccagcatgtgattgtggttgaccgcccagataaacagcagccagttactggcaatcaaaacggcggtcaccgccagtaacaataggcgcttacggtttttgcaggcgtcgcgcacctgtggccaatggcggctgacggtaagcagaatcaacataaagaagaatgaccagatgaccctgtgggtcagaatctcatcagcgggcacttgttggatgagtttgaaatacgcgggagcaaggccccaaataaaataggcagccagagcaaaaaaaatgccctgacgagtttgttgtttatccatggagtggctcggtacagaatacaagaaaggagatgcggttagtgtacttaactttgcgtggcgaatcacccacgcagtaggttaaattagccaaccagataggtcgccgtcgcgctggcgatatgaatttgtttttcattatgcagttcaacccgggcgacagccactttgtttccactgcgtaagatactgcttctggcgataaaatgctcaccacggccagggcgcagatagtcgacgcgtagatcgatagtgcccattttagccagctttatttgcagttgctcttgaatcagtggttcatggcgtatcaggctattgccaacacaaaccagacccgcggcaacatccaatacggcggcaatgaccccaccgtgcaagatcttttgcgcgatattacccaccaacttgtcatcattatcgaaggtgatttcggcataatcttgttcaaaacggactaattttagccctaattcacggttgaatggcatgtgataaacaaaggtttcgccgatcatgcggcgagcgtcttccagtgttaagggcgttactgacattatgttctattctcttctcttagttatcgcttagaaacagccgttatcgatcagaagcaatcacattatacgttaattaattgtttattttatgcttgtattttgttgttttccagccattaaatcataaagataaacaacactaatccaaggtaacatttgtgtgtagaatgagctgttttcattaaaaatagaaataatccgagggtggtgagggaattatggcgagattttggcagatactgattgcgttattactggtgccaacattggcacaggctgaagaagcaacgattgaaaagattcatgatgcgcccgcagtgcgtggcagtattatcgcggcaatgttgcaggaccacgataatcctttcctactttatccgtatgaaaccaactatttgctctacacctataccaacgagatcaataaacaagccattagctcgtatgattgggctgaacaggcgaataaagatgaagtaaaattccaactgagtttagctttccctatctggcgtggtattgccggggataactcattattgggggcttcttatacccagcgttcatggtggcaggcatccaacagtgaagaatcttcaccttttcgtgaaaccaactacgagccacagctgtttttggcgtggtcaacagattacgaattggctggctggactttccgcgaagtcgaatttggttttaaccatcaatccaacggtaaagctgacccaacctcacgtagttggaaccgtgtttatacccgcgtgatggcacaacgtggcaatttggaaatcgacctgaagccttggtatcgtattcctgaaagcgacagtaaagatgataaccctgatattacgaaatacatggggtattatcgcctgaaagtcggctatgccctgggtgacagcgtattcagccttgatggtcgctataactggaataccggttacggtggcgcggaaatgggctggagctacccaattaccaaacatgttcgcttctatactcaggtattcagtggctacggtgagtcaatgattgactataactttaggcaaacacgggtgggtgtaggtatcatgttgaacgatgtcctttaacgtcatccggcgttatcacagtttcagacacaggccggtcagccggcctgtgcagatctaatagttggggaaaagtgtgtcgaccgcagcagtgataaacagggaattactggcagtgcaggtattgcgagatacttttggttatcagcaatttcggccagggcagcaggagatcatcaacgcgacattgtcaggccaggattgtctggttgtgatgccaactggcggcggtaaatccttgtgttatcagatccctgccttggtgaccgatgggctgacattggtggtttcaccgcttatctctctgatgaaagatcaggttgaccaactgttggcctatggcgtgggcgcgggttgtctaaactcatcgcagacccgtgaacagcaactggccgttatggatggttgccgcagtgggcagattaaattgctgtatatcgcgccagaacggttggtgatggagagttttcttgatcaactgtatcaatggcgacccgccttgctggcagtggatgaggctcactgtatttcccaatggggccatgatttccgcccggaataccgtgctcttggtcagttaaagcagcgtttccctgatctaccggttattgcattgaccgctacggctgatgaagcgacgcgtggcgatattgtgcgcctgttgaatctggatcaacctctgattcagatcagtagttttgatcgcccgaatatccgctataccttagttgagaagtttaaacctctcgatcaactgtggcgttttgtacaagaccagcgcggcaagagcggcattatttactgtaatagccgagcgaaagtggaagatacgaccgcccgtttgcaaagccgtggcttgagtgttgccgcctatcacgccgggctggataacgagcgccgtgctcaggtgcaagaggctttccagcgcgatgacttacaagtggtggtcgccaccgtagcgtttggaatggggattaacaaaccgaacgtccgctttgtcgtgcattttgatatcccacgcaccatcgaatcctactatcaggaaacggggcgcgccgggcgtgatggcttaccggctgaggccgtgttgttgtacgatccggcagatatggcgtggttacgccgttgtcttgaagagaaacctgcgggtgctcagcaagatatcgaacggcataaactcaatgcgatgggggcatttgccgaagcgcaaacctgtcgccgtttggtgctgctcaactattttggtgaaggtaaacagcagccatgcggtaactgcgatatttgtctggatccgccaaagcgctacgatggtctggcagatgcgcaaaaggcgctctcttgcgtctatcgggtagggcaacgctttggcttagggtacatcgttgaggtgctgcgtggggcgaataaccagcgtattcgtgagatgggccatgacaagctttcggtgtacggcattggccgtgagcaaacccatgaacactgggtcagcgtcttgcgccagttgatccatttggggctgctcagccagaatattgcccagttctctgccttgcaactgactgaagcggcgcgcccggtcttacgcgcagagctgccattacaactggcggtaccgcgtattcagagcctgaaagtgcgtagcagtgccaatcagaaatcctatggtggcaattatgatcgcaagttgttcgctaagctgcgcaaactgcgtaaatcaattgctgatgaaggcaatatcccgccttatgtggtgtttaacgatgcgaccttgctggagatggctgagcagatgccgattactgccagcgagctattgagcgtgaatggtgtcggtcagcgtaaactagaacgttttggtgcaccatttatggccctgatccgtgatcatgtggataacaacgatgactaaatagatcgggttagccgttggtgctacccgatgatcctatcaacgataaaaatcgaattgcgtgttagcataatttttcgatcttccctgttatgagtggctatctatgttgatgctatttctcaccgttgcgtttattcatctggttgctctgattagtccagggcctgacttcttttttgtatcgcaaactgccgccagccgctcacgtggtgaggcgatgatgggcgtgctggggatctcgctaggaattgttatttgggctggggtagcactgatggggttgaatctcatcttgcagaaaatggcttggctgcatcaaattattatggtcggcggtgggatgtatctgtgttggatggggtggcagctattgaaatcggcccgtgctaaacatgatgtcgccgaagaagaggtacaggtcgtcttgcctgcccgtggccgcacgtttatccgtggtctgctgaccaacctgtcgaacccaaaagccgttatctatttcggtagtgtattctcatggtttgtcggtgatgacgtgggtgcaggtgcgcgctgggggttgtttatcctgattgttggcgaaaccttcttatggttcaccgtggtggcctgcgtatttgcgttacccaccatgcgccgtggttatcagcggctttccaagtggattgatgggctggcaggtgtgttatttgccggttttggtatccaactgatattgtcccgctaacgggttagccaacggggtatttaacccggttggctagcctgacaggctctttatactttgcgcgctgtggctaataatgcaccaatcaacataaataggccgccaaatattcggttcaagagtttcatttgctgtggcgatttaatccaacgggcaatacgtgtagccaaagtggcataaccaatcatcacgataatatcgacaatcacactggtgctgcccaaaatcaaatactgtgccacctgcggttgctgtggcagtacaaattgtggaaataacgcggccagaaaaacaatgctttttggattggtcaggttaacaaacaccgcacgtttaaacagcttacgcctgggcatactgtttgccagtgcatgcaggtcaagcgacccggctgcacgccattgttgaataccaagccaaattaagtaagccgcaccgagccactttaatatttcaaatgccagtaaggattgagagaccagggcaccaagaccgacgccaaccaagacgatatgcaccgccagacccagttgtaacccgccaatggaagcaacaaccccacgggtaccatggctgatggcagtgctcattgtgttaatggcccccgagccgggagaaagactgaggatcaatgttgtcagcagataggttaaccaccagtctaaggtcatcggcaagctccctgaatgggcaaatttatgccacaatacctcattgccaatagttgtgctatggctcacaaaattctgggcaacgtcggctaaagcgtgccattaatattctctatgttattaaaatataacatcagggctataaattcaggttacgtaaccagtgccatataaccagagttacataactgaactatgctgttaggtcatcacatgaataattggttaacccgagaagagcaatttgctgcttttattaatgggccattgttggatttctggcagcaacgagacgaacagacgtttatgggcgtcgataatatccccattcgctatgtccgttttcgtgcgccgcatcatacccaagtcgtggtggtagtgccggggcgtatcgaaagttacgtcaaataccctgaagttgcttatgacctgttccagcagggctatgatgtgatagtgctggatcatcgcgggcaagggcgttctgggcgtatgctggatgatcataaccgtggtcacgtgattaagttcgatgactatattgaggattttgcacaactggtgcagatcgaaattaccggtagccattatcagcagcgttttgcgctggcccactcaatggggggcgcgattctgacgcgttttctagccagagagcctgatgtatttaatgccgttgcgttatgtgcgcccatgtttggtattcatttacccctgccgggctggttggcacgccgtattgttaactgggccgaagggcaccaaaagctacgggattattacgcgattggtactgggcattggcggccactgccgtatttggtcaatatgctgactcacagccgcgagcgttatcgccgctatttgcgccaatattcagacacaccagaaatccgcgtgggtggccccacttaccattggctacgtgaaagtttgctggtgggggagcaaattattgctgaagcggagaaaatcaccactccggtattattgttacaggccagtgaggatcgggtggttcataacccagcccacgatgctttttctcaggcaatgacattggcagggcacccctgtgaaggggggcgtcctcaggtcattcaaggcgcacgccatgagatcctgtttgagcgggacacgctgcgtgccgaggcgcttagcgccatattgcgctttttcgcgcaacatcaatcatcagtcggccattaggcgccgacgccaccagaggttagaacataccattatgtatcatgttgttgcttccgatttagatggcacgctgctatcgcctaatcatacgttgaccccttatacgaaagaaacactcaaattgctgacgcagcgtgatgtgcattttgtgtttgccaccgggcgccaccatatcgatgtggcacaaatccgcgataatttggagatcagtgcttttatgatcacctctaacggtgcacgcgtgcataacactgagggagaattgattttcagtcataaccttgatgcggatattgcccgtgatttgtacaatcttgaacatcataatccggatatcctgactaacgtctatctgggcgacgaatggtttatgaaccgcgaatgtccagagcaagaagagttcttccgtgaatccgtgttcaattatcaggtatttgaacctgcattactgccgactgacggcgtatgtaaggtgtatttcacctgcgaagatcatgacaagttgctgatcttggaagaggccattaatgcccgctggggcgatcgcgttaacgtcagtttctccttccctacctgcctggaagtgatgggcggcggcgtgtccaaaggccatgcccttgaacaggttgctaaaatcatcggttattcactaaaagactgtattgcctttggcgatggcatgaatgatgtcgaaatgttgtcgatgtctggcaaaggctgcatcatgcgcgacgcgcatcagcggctaaaagatgtgttgccgaatttggaagtgataggctctaacgctgatgatgcggtaccacactacttgcgtaagatgttcttaggtaaggaagagtaaggttaacgttgcagtagtatgatgatgctgtggagtagggtggcctttggtcaccctttctccttggcgttgcaggggggttagcggtgcgcactcatctttcaaaatcatccttcaaaattatgtattccatgaacaaattctaaataattatttaatgacattaaactaattataataaagactaattagtctttctatatattcatgaagataatggtatctcattgttttaatttaatattaaagcaaaatttatctgaatggagttaaatatgagtgatataaacgttacctccccccatttcatacctatgaaaagtcctattactgcaagattagataatagtgatttgatcgatgaacggcctcagaagattaattttctcggtaataaattaaactccatagccgatgttaatattgactcaaaaaataaaaaaataacaataaatattgctgagaagaaatttagtagtgactatattcctgaggagtatatctatattgccgtgtgggatgctaaaggaaaaatggtttttcaaaaaaaattatcagatgcagagataaaagaagagaaaatagaacttccatttgaggtgggttatcaacttgaaatgtaccaccctatacccagcagactcgttagttctcctgatctttatagtattattgactccaattctccatttactcttcttgtaatgacgccattaggtgtgacaaatcctaagatggaatcttatcctaccgatattatcgaggcggattttattcatccaaactccgtttcagtgggggtcaatgcggatgttattgaacctgcatctacagcggaacccacaacgtctacccctatcgctcctgatatcccttctgccagcaccgatcccatcgtcagcaccagtacccgcacgggtatcgattcgacaacaaaattgatggtatcgttccagttcaagctgttgggcgtatgtgattatgatattgcgacagtgaccatcgatgaagagagtaaactggcgggtattaagattgttactgacaccccccattgtcattttggtgatgagctgtatgccagtattaaagtgaccgataaacaagggcacatcacgtttgaggaaaaactttatggcacgaatgcgaatatttcaaataccattattcccttcgaaaaaggttataaattagatatcttccatgctgagcctagccggttacgtgtttcatccggtgatagcgatactttaattccagagtccaagcagaatagttttatcatgacatcaattggtatagaaaataccaggcagggcagtgccgaggcaataatatcagatcaattcgatacagaaaaattggttcaagatatgtcttctttcggtgattcttccattgcgcccgtggataatgtctacggatacatgggtgaaaaaaatcactatcagaatgtagtgagtcacgttgaataattaattatggctctctttcctctgaatctctgaagagaagaaagagaaaaaagagagccatgtttacggcgagttatttatgctgttgctgtttttgcaggaactggatgccttggtccgggaagtcagtaaatacaccatcaacttgtgcctgattgtaaataatatcaaatagttggttaatatcggtggcgtatttaggtagcctatcagcccgtatcgtgaacggatggaccatcatattgctggcatgggcttctttgaccagatcggtcaacttgatgtcttttgctgtcgatgttttaaccactaacatgtgatagtcagggccgatgccatcagcatagtgcgccacttccttcatcgcacctggcttgaacatccagtcatagttgtaattaacccatttgccatcaggtaattgctcgtaggtttcattccagtcagtgtatgcgatcagttggatcagtttcagatccatccccatcttaggttccagctcattcttaatacgttttaattcatttacatcaaaggattgcagatacactttatcgtctttattggtgtagccgtattctttcaggacttccaatactttggttgagatgtctttgccttcttgatgatggaaccacggcgcttttatttcagggtaaatacccgtatttttaccggtcgagtggttcagcccctgaatgaattcaatttcctcttggaaagtgtgcacccggaaatcagatttgcccattgggaaacggttcggatagctctgtactttcttaccgttcttatcaatatcaaagccttcggtaaatttcagcgacttgatttctggcaacgtaaaatcaatggcataatagcggccatctttccgtgcgcgatcagggaagcgttcggcaacatcggtcacacgatccagataatggtcgtgcaacaccaccaattcattatctttagtcatcaccagatcttgctctagataatcagcgccttgggcgtaggccatggctttggctggtagtgagtgctcaggtaaatagccgctggcaccgcggtgagcgatgacgactttatctatggcagatgcagatttatccgcagatgctggtttcgcagcataggccggggctgccatagaggccgccagaatcagacttgccaacagcgttttgacgtgagtttgcatcaatagtgctccatttgtcggttttatacccttcttactcgaggttgctgcctggccgcaacgccaattagtaacagcaccgcgatgccgccgccgaaagccgccgtctcaaccgaagtcgtcaacggtgtagcctacgatagcactggctgctaacgagccacccagataaccgaacaagtcagtcgacccagtctgcggctagccttgcctgatgtgccgcaggcattgaaaatgctcaacatgctatgcctctgatggcgttttattgttttttgactccggtatagcctggcatttacccggttattgaacagttaactcgcgtcgtttatgttccatagcgaatgtcatgctagataatatgggttgctttatctggggggatggcgaaattgttacctattttatgaaatcggcggcaattttgggtgattattcgacattttgaaacaagtaataacaaatcacctgtgattttgatcacaatcatggtttttaaacaccacattgctttcgttttaggttcgtttttgtttcttatcaatcaatatctataaagactgtggctcaatagggacataactcgccagcaggcggctgtctgataatctggggtctttcatgacgaacagttctccttatctagaaacggatgtcatcattatcggtggcggagcaaccggtgccggaatcgctcgcgactgcgcccgccgtggtttggcttgtactttattggaaaggcatgacatcgctactggggccacggggcgtaatcatggtctcctgcacagtggcgctcgctatgcggtaaccgacggtgagtcagcccgtgagtgcattgaagaaaaccgcattctcaaacggattgctcgccactgcattgaacaaacggatggcttgttcatcaccttgccggaagactctctggcgtatcagctacaatttatcgcccgttgtcgggatgcgggcattgaggctgaagccattgatccggcacaggcactgcgcttggagcctgccgtcaaccccgcgctgattgccgcggtccgggtccctgatggcactgtcgatcctttccgtttaaccgcggctaacatgttggatgcccgcgaacatggcgcgaatattctgacatatcatgaagttatcggtttgttgcggcagggttcccgaatcaatggtgtgtgcgttttcgaccataaaaatcagcgaaaatacgacattcatgcgcagattgtggtgaatgctgctgggatctggggacaacatattgctgaatatgccgatctgcgtatccgcatgttccccgccaaaggcgcgttgctgatcctcgggcatcggatcaataacatggtgatcaaccgttgtcgtaagcctgcggatgccgatattttggtgccgggcgataccatttcattgatcggtaccacgtcaacccacatcaattacgatcaaatagacaatatggtagtaacggcacaagaggtggataccttaattcgtgaaggtgccaaactttcgccgcaactggcgcaaacccgtattttgcgtgcctacgcgggagtgcggccgctggttgccagcgatgatgatccatcagggcgtaatgtcagccgtggcatcgtattactggatcatgccagccgggatggggtggagggttttatcacgatcaccggtggcaagctgatgacctaccggctgatggcggaatgggcaaccgataaagtgtgcgaaaagttgggtatcagtgcggcttgtaccacagcgcaagtgccattacccggctcacggcaatccgcagaacagactttaagcaaagtgatctctttgcctgccagcattcgcggttcggcggtttatcgccatggtgatcgtgccacgcagttgttggtgggaaaccggctggataacagcctggtgtgtgaatgtgaggcggtcaccgccggtgaagttcgctacgcggttgaatctttatcggtcaataacctgttggatttacgccgtcgtacccgtgtggggatgggcacttgccagggagaactgtgcgcttgccgtgcagcgggcctactcagccgctttaaggtgaccacaccgcagcaatcccgtgagcaactgacacaatttctcaacgagcgctggaaaggtgtacgcccaattgcttggggtgatgcattgcgtgagagtgagtttacccagtgggtctatcagggactctgtggtttggatgagattccagccaccgtgaatgcgcgggagaaacacgatgaaatttgatgtgatcatcattggcggtggcttggccgggttggcctgtggtattcgtttggccgaacaaggtaaatattgtgcgattgtcagtgccggacaaaatgcactgcatttttcctctggttctctggatctcttggcaaaattacccgatgggcgggcggtcagccagccattatcggcactcagtgcattagctgaattagcccctgaacatccttacagtaaaatgcggaatatcacgcaattggatgagttggtacaggaagccgaggctctattacggcggtgcggtctggatatcgttgggagtagcgctgaaaaccacttacgtctgacgccattgggtagctgccgtcccacatggttgagcctggcggacatcccggttgcaccgttaaatggcccgctgccgtggcaacgcgtggccgtgattggtattgaaggctttctcgattttcagccacagatggtcgcgagtgccttacaggatcagggtattgatgcgacggcagattatttacatttaccggcgctggatcggttgcgggataatccgagcgaattcagagcggtaaacatcgctcgaatactggatttaccggaaaatcgacaacccttagcggatgagttatcccgcctgtcatctaccgctgaaatgattctattgcccgcctgtattgggctggataaatctgcgccattagatgccctacgcgccgtggtcggcaaacctattcaactgttgccgacattacctccttcgctgttagggatgcgcttacatcaggcgctgcgccatcgcttccaacaattggggggcttagtgatgccgggtgatgcggttttgcgggcggaattggttgataaccggatcactggcctttatagccgcaaccacggtgatattcctctacgagctgcgcagatggtactggccagtggcagtttcttcagcaatgggctggttgctaccttcgataaagtctatgaaccgatactggatctggatattttatcactgcctcaccgcgcagactggagccacagtaatctgtttgcgccgcagccttatctgcagtttggtgtcaacacggataaccatttacggccgctgcgtggcggtgtcgccctagagaatctacatgccatcggtgccgttctggggggatatgatccgctccagcaaggttgtggcgcgggtgtttcattgaccagtgctgtgtttgtcgccgaacagattatcagcgagatggcggtgacattatgacagggttgccaaagcatgatgctagccccgaacaggatggcacgatggtgggcgatagccgtctcacgcgagataatagcttcgaaagctgtatcaaatgtacggtctgtacgacttactgcccggtggcaaaggttaacccactctatccggggccgaaacaagctgggccggatggtgaacgcctgcgtctgaaagatccggcactgtacgatgatgcgctgaaatattgtaccaactgtaaacgttgtgaagtggcttgcccatcagatgtcaaaattggcgatattatccaacgggcgaaagccagccatagcactaacaaacccaaattacgcgatgccatcctcagtcataccgacatcatgggcacgctttcgacaccgtttgcaccggtgatcaatgcggtgacggggttgaaacccgttcgggtattgttggacaaagcgctgaaaattgaccatcggcgtgaattacccaaatactcatttggtacctttcgccgttggtatcgcaaacaggcggaaaaacagcagcaatataccgagcaagttgcgtttttccatggctgttttgtcaactataaccaccctcaattaggcaaggatttagtcagcgttttcaatgcgatgaatatcggtgtgcagttgttgaaacgtgaaaaatgctgtggtgtcccactgattgtaaatggttttattgagcaggcgaaaaagcaggcgcgggtaaacctggaatcactcactgatacggtcattggccgtgatattccggtagtcgccacctcctcaagttgtaccttcaccctgcgggatgaatatcctcatttattagatgtggatacgaccccggtgcgcgataaagtagagttggcgactcgctacctttaccgcttattggatcaagggcgagagctacctctgaagcctttattctcattaaaccccttattggcatctcaagaagccccattgcgcattgcctatcacacaccttgtcatatggagaaaatgggctggacggcctataccctggctttgctccaacggatacccggtgttgagctggtggtgttagattctcaatgttgcggtatcgccgggacctatggttttaaatcagaaaactacgcgacatcgcaagggattggggcatcgttgttccagcaaattgaggatagcggggttgatttggtgattaccgattgcgaaacctgcaaatggcagatcgaaatgtcgaccagtaagaaatgtgagcacccgattactttactggcgcgggtattggcttgatgggggtaaaaattatggttgaggagatcgataaagccgagcaagtgaataacgctgaataaattaataatgccgagtaagctaataacgctgagtaagtcaataaaacagagcgcgagtgagccgcgctctgctgggacagattatttcagcttcaaggtactgataatggattcggcttcggtttgagcttgctgctgattctcggcggggagcgtaatctgcaatgtcattaattggttaccgacggttcccatgacgatagatgaatacgctttttggccgctactggtaataatgctgtccagttgctggaacggttgcccgttaatattaatcgtcttgttggtcaccacttgcaggtttgcatcgcgggcgcgctgctgctcggctaaacggttggtcagcacttccaacttttcattggtgccctcacctaaaatgacgatcactgctttatcaccagtattattggcgtaaacgtgcatgttattggcttgattacccatcttcccgctttggtctgacaggtctgctggcaagttaaaggtcactttgccatctaacaggctgacggtctggcccacgttattatcgctactgttatcacaggcgcttaatcctgcgaccagcaggccgacggcaagaaatcgaactatttttttgtacatgggtatcccttattcatacgtgtatgcctttcgagccacgggcggatgtcgataacgcctcaacaactgacaatttatcaatagttgctaagttattctatcgcaccttattcagacgcgaaaagcaacctatcgttcagttgccagcactggctgacccgtctgccgggcaaagtacttcagcaacacattcagcatcacgccataagctggcaggaagaacaacatgcaaattaacagcttaaagctgtaatcgactaacgcaatttccacccagtgtgctgccataaacgggtcactactgcgatagaaagcaatgaagaagaatgccatggtgtcactgatattgccaaagaacatggccgcagtaggtgcaacccaccaggcattacgctgacgtaggcggttaaacacctgaacatccagaatttggccaagaacataggccataaaactggcgacggcgatacgagcaaccaccagattaaaactggttaatgcggggaacccctgccagcttccctgataaaacagtgctgatatcagatacgaaatcaacaacgcgggcaccatcacggaaagaataatccggcgcgccaaaggggcaccaaaaattcgcacggtcaggtcagtggctaagaagataaatggaaaggtaaaagccccccaagtggtatgaaagccgaagatagcgatcggcaattgcaccaggtagttactggaggtaatgatgacaatatggaatagcgatagccataccaacgcggtcatccgctgttgggcagtaaacgaaaacataaatgtaacctttttggttattggggtgagggaacccaaacaaaatatgccgcaagatctacggcgcggcggcataatacgcgtttgcgcaacgaatgcaatggttaattttaacgcaaacgattaaggtaaattctttaccttggttaagctatttgcttttgttaaaccatcggatttcgttaaactggccgcctttgtaagcttgctgacattttatctttctattaaaccgcttactgacgaattattaaaccgtttactgacgaacaagagaaccgccatgaccgatatttttgctaatccagataaaacccttgatgctctgggcctgcgttgcccagagccggtgatgatggttcgtaagacggtccggcacatggaagagggccaaaccctactgattattgctgatgatcccgcgaccacccgtgatattccgggcttctgtcgctttatggatcaccagctactggcgcaagatactgaacagaccccctatcgctatttggtgaggaagggaataaccgcaggttaatccagtatcttgctgatcaagcatcgatttaatcaaacattaacctaatcaaacattgacctaatcaaacatctcgcttgcgtaacaacctcaacgcattcgctgtcaccaaggctgttgcgccggaatccgccaatactgccagccacaagccagtcagacccagcagggtggtgaccaggaagatggctttcaagcccagcgcgatagtgatgttttgacggatattcgcgttagccgcccgtgagagcagaataatctccgccaacccggtcagccggttatgggtcaatgcggcatccgcggtctccagtgcaacgtcagtgccgctgcccatcgcgaccccaatactggatgctttcatggcgggcgcatcattaataccatcacctaccatgaccgtcggttgcaatgcattcaatgccatcaccgcctgtactttatcggctggcagtaacccggcgcggtaatcaatccccagttcaccggcaatggcggcggctgcgcgtggattatcgcccgtcagcatcactccctgaattcccaattttttcaaggcatcaatcgcctgtttggcatcggtgcgtaatgtgtcacgcagcgccagcaagccgatgaatttttcatcctccaagaccacaacggctgttttaccactgctctccagttggtcgatctgtgccagccattcatcggtcagtagtgccggagacaacttgctgggtgcgctgacacggaccatcaaaccattgaccacaccttcaataccgacccccgccaacgcccggcgttcttcggccagtggcaacattggcgtattttgctgagcacgttgattttgctgagcacgctgattttgctgagcacattgtatgatcgcgatggctaaggggtgatgtgaccccgcttctaccgccgcggccaaggtgagcaaccgggtttcactgatgcctgagatgggcagaacgtcagtgacttttggtttaccctcggtcaaggtgcccgttttatcaaatgcaatgatttggctacggcccagttgttccagtgccgcgccgcccttgattaaggccccacgccgtgttgccgccgccagtgctgaggtaatcgccgcaggggtagaaatcactaacgcacacgggcaaccaattaacaacagtgtcaggccacggtaaatccaaggttcccaaggtgcggcgaaaactaatggtgggaccaaaatgaccagtatggagaacaggataattatgggggtgtatatacggctgaagcggtcaataaaccgttcaattggcgcacgacgctcttctgcgagctcaatcagttgcagaatacggtcgatggcattattccccggttccgatactacgcacatttcgacggcacgatcaacggacaggcagcccgcggcgactttttcgccttgctgacgttcaacggggatggattcacccgttagggcgctttcatcgaagctggcgaaagaggcctgtagttcagcatcggcaggcaggcggccccctggtgggatttcgataatatccccagggcgtaaatctgcgacaggaactaatgtgcgcttaccatcctttaacagtaatgcctcttctggtaccagcgccatcagtgcggtgacgccgcgccgcgcacgattcactgcataagactcgagtaactcacccaccataaacagcagtaataccatggcggcttctgcggttgcaccaataaacaccgccccgatagcggcgacgctcatcaatgtttcaatggcgaaaggtgtcccagaacgaatcagtttccaggatttgatcacaaaggggatcaagccaacgatggtggtgatagtgaacgcagtttggctaagttcagtattgaagaaggataatccccaactgataagcattaaggtgcttagtaatgccagtggtaaatactcacgaagacgtgattccgtggcaacgtttttctgcccggcagtggtttgggtatttaccaggctaaatccagtagcaatcacggctttctggacgagggaacgcacatcggcacgggcatctaccaccaatttctcggtggtgaacagcacttttaccttctcaacgccatcaagtccgctgattgcattttcaattttccgggcgcagctcgggcaatccatccctttaacttgccaactgaaacgttgggttccgctaacaatagtggtatcaagtcgatcactctcttcgtcagcctcatcggcatgagtatgactacaactctctccgtcatgatgtgagtgttcacttacagaatcatgactgatagcgtcgctgttagctgcagtagccagattgctacaaccggtttgatgtttgtcatgagtatgaccacagccacaattactgttggtctctactgatttctgatgctcagagtgtgaatgcatgatgctgctccctatgcaggatgtaacaggtatatgcccatgtcccttaacgttgcagtggtgccagtgaccgcgctgcgacgccagattctttggatatagctgtactctacaccttggagccaactccagagtcaaggggttagatgagaatagttgttaaataggattatttttattgactgccaaccgagggaaaaatgaaagagagggggccgttatgcaccaatataccgttatgcaccaatatactgagatgaggacatgaagactcgctccgtccgtggagcaacttagtcatgatgttcagtaacagggcatgggtgagatgaattataaatatattatttatcaatgtactcgctgccaatatcttagatattgatacactcgtgaccaatacagatgctcagctacagatacagcgacctgacaatcaaaaagtgcccgataaaatagcacccggcagcgatggcatctgacgcgcggaaagagaaacggtagcgattcagcaaccagacagcatgtgatagcaggagaagaacactacccgccagtaacgagaagcccaaatcagtgctacgggcaaagtactgttcacccgccatccaaaccattagcaaggtcataccgataaaggcgacgactggccagcgcatatcttgtagctgtgtccagagagcggctaacagcagagcgccaaccacgatcaacaccagaggcaatggccagaatagcgtcagggtcatctgactggcaaaactgatggtatacagcaagtgggataggaagaatgcccctaaagcataaagtaagcgctcactgggtagcagtaataaggcatcggcaagcagtgttgccagtaatcctaagacaatcagataacctgcaggaccaagagcaggtgcttgccaggccagtaacagtaacagtaacaaggtgacgggtttgaatacccaacgctgccagcgggggccacgataagtggcatcgacaaacaaccaaccagaaaaaaatacagcaaggaatggccagctcattatttatccttttctctattcaggtttatcgaagacgcctgtgttgttatgacaatctgcaattcatgtacaatactgtacaacactcattagtgtaagggatggaggcaaagagcgatagccaggcaagtgtcatttgcttgggttatgcaacttaatgcgtaacagcgcgcagattaaactttaaggcaccagctctgcatgctgatatcttggtcttgtttggctcacatgctatgttaacgccgatttcctctcgttataacaaggaatagagacaggtcacgctatggcgaatgaacaactgctttatcgtattcagtttataaataatggtaaaaattatcagctttatgtccgtgaaatcggttctagctcgttatttggatttattgaaattgctgattttgtctttgatagccaatcaacattgttagttgatccctcgacagagaaattgaaaactgaattttctggtgtcaaccgtagctatattcctctacatgcggtcattcgtattgatagtgtcactgagaaaggtagcgcccggatatctgagcttggcaacaatgtgatgaatttcccctatttaccgggtaataaaccctaagaatatttaactggggcgctatgggtgtcatcttttacggtttttacggtgtccctgtcgtatcattgatggggcgggtatgctgaatttttgccattaacagctttttgggtcattaatggtttttttgccattaatagcttttagtgggtaattattttgagttaataatgatttttaacggattatatttaatcgatagaatgcagatatgagcaaactccctttattatttattgccgttgtggtgctgatcgtcgtgctggcaacccgccagtattggcagaaaaaacagcaggatgcagaaaatgatcgcgcaccggtgcgtagtgtgcaagttgaggtcgttgataaacgtgaagtccttgcccccaatcgccgatcaaggcagcgcgaggagatcgtggctgaagagaaacgctatgaagtttatttccgtccactgtccagtggcatagaaataaagaacagcctcggactctctggaggcaatgaaataaagagcggcagtgaaattaaaatggtattgccccagcaggaatataaccgtattgagcaaggtgcacagggaatattgcgtttacaaggtacgcgctatatcggttttatcccggatgccccgcatccttgacgcttaccctgcgggcaagcaaattatttagggtatatacccgttgccctttaaggtacaggggattaggggttagctgcccttgctcaccccagtcactgaggcctggttgtttactcagttgctgcctgcctgcatcttgaagtaacttgggtatatagcattgggtgacgatattattttttaggcagttgtggctgtttcttctgccaggctaataattcaaatacgccaaaaacaaagattttaaattgctgtaacccactgataggttgatccttgggttgtgtcgatttgagcaagaccagttgcaagccatgcatcagaaccataaatatcatggccacatggataaagtatctcaatggcttagggtaaggctggaacagattcagcagtataaaaaaccagacgcctagcatcagtaaccggccgagattaatccacatggtgttgctcctgctctgccaccgatgtacatgctggcaaatcggtttgttggcgaataaataaacgataggcaacctgcccggcgattttttctcgatgtaacagccaattggcggggacatcagcaacggcgctttctgcctccgcttcaacatagatccaggcatcagcagccagccagttaaattgctctagcaaattaatggtttcagccagtaggcctttacgaaaaggcggatccagaaataccaaattgaaaggctgccccggttgcgccaaccattgtaatgagttggtgtttacaacttgcccattttcagcttttagtagcgttaggttgtcgctcagttgtttggcaacctgacgatcagcttccagcaaggtagtttcgcttgcataacgggatagtgcttccagccctaacgcaccactgcccgcaaaacaatccagacagcgagcaccctgaatcatcggagcgagccagttaaataatgtttcccttacccggtccgtcgtggggcgcagccctgggctatctggaacggggagtttacgcccacgccacttgccgccaatgattcttatctgccccgctgactgcggtgatgctttttttactatagaacgctttgctataggttgctttgccatagattattttgcttgaaaattggccattattgcagcgctgaataaaagaattagcaactattctaccgatgtgtgctgtgtgggggaaacgttatatccccttcggactttaggttgcagagatgttcgcgataacgattgaattcacagtagaaagcatcatcgtgcgcgtgttgctgtccaggagaaagtgatagacttgcacattattattgtacccaaggctattattgtacccaaaggtataagccatgatttaaccgcgaggagtgtagtcgcaaatggcaaaagaaaaaaaacgtggatttttttcctggctgggtcttggccgtcagagtgaagaaccagcagcagagccgctggcgactgaaaaagaaggcgttacagagcaagaagacgttattgaacaaaccggcgttattgagccaacagacgttattgagcaaaccgttgagcacgtcattagtgaaaaaacgactgaagctcccgcggagaatgcctttattgaggtagaactgcgcgagcaggtcgctgcggtaattcctactgagccgaataacgccataatgagtgagggcgtccctgacactttaccagagagggcggttgccgaatcagtagttgccgaattagtagagaccggtgacaacgcggccattgttcatgatgagattatcgagccaataacgcaggtaacggaagctggcggtgagctctctttagtaaaacctggcatcgagggtgataccactgaacagggcggccccacagacaatctgccaaaacggtcgttaacggaagacaaccttattattgatgttcccaccccgcaggcggtggtagaagaatcgcgggttgacgctgttgagcaacctaccgaaacttctgaagttgaagaagttgaagaagttgaagaagttgaagaagttgaagaagttgaagaagttgaagaagttgaagaagttgaagaagttgaagaagttgaagaagttgaagaagttgaagaagttgaagaagttgaagaagttgaagaagttgaagaaaaaattatcccggtagcggctcaagaacaagagcggccaaccaaagaaggtttcttcgcgcgtttaaaacgcagcttaatcaagactaaacagaatcttggctccggttttatggggctgttcagcggcaaaaagattgacgatgacttgtttgaagagctggaagaacagctcctgatcgccgatgttggtgtcgaaacaacccgtaaaattattacttctctgacagaacatgccagccgtaagcagttaaaagatgctgatgcgctgtacggcaagctcaaagaggaaatgtctgagattctgtctaaagttgacaagccattagatgttagcggcaagagtccgtatgtcattttaatggttggcgttaatggtgtgggcaaaaccaccactattggcaaactggcgcgccaattccaggctgaaggtaaatctgtcatgttggcggcgggtgatacattccgtgccgctgccgttgagcaattacaagtttggggtgagcgtaacaagattgcggttgttgcacagcataccggtgcagattccgcttcggttattttcgatgcgattcaggcggctaaagcccgtggtattgatgtgctgttggccgataccgctgggcgtttacaaaataaagcccacttgatggaagagctgaagaagattgtccgggtaatgaaaaaactggacggcgacgccccccatgaggttatgctgacactggatgccagtaccggacaaaatgcggtgagtcaggcaaaactgtttaatgaagcagtgggcctaaccgggattaccctaactaaactggatggtaccgccaaaggcggggtgatttttgccattgctgatcagtttgagatcccaatccgttatatcggtgtcggagaaggtatagaagatttgcggccatttaaggctgacgaatttattgaggctctttttgcccgagaggattaatacggatgattcgctttgaacaggtcagtaaagcttatctggggggacggcaggcgctgcagggggtcgattttcatctgcgtcctgcggaaatggcgttcctgaccggccattctggtgcagggaaaagtactctgctgaaactgatttgtggtatcgaacgccccagtgcgggtcatatctggtttggtggtcatgatatcagccgtctgaaaaaccgtgaggtgccctttttgcgccgccaaatcgggatgatctttcaagatcaccacctcctgctggacagaacggtttacgacaacgtcgctatgccactgattatcgccggtgcgagtaccgaagatattcgtcgtagggtctcggctgcactggataaagtcggcctcttggataaggcgaaaaatttccccattcagctatccggtggtgaacaacaacgcgtagggattgcccgcgccgtagtgaataaacccgcggtattgctggccgatgaaccgaccggtaacctggatgatgccttatcagaaggtattttgcgtctgtttgaagagtttaaccgcgtgggggttaccgtcttgatggccacccacgatacgtcgttgattgcccggcggcgttacccgatcctgacgttgagtcaggggcggatgtcaggagcacaccatggcgaataatgcgcgaaaagcaaaaaccaaggctctaaagggcggttggcgtgagcagtggcgctattcgtgggtcaatgcgattgccgatatgatgcgtcagcccatggcgacgctattaacggtgatggtgatatctatttcgctaacgctgccaagcgtatgttatatcgtgtggaagaacgttagccaggcggcggagcaatggtatccaacaccgcaactgacagtctatctggataaagcactggacgataacgcggctgagaatgttgtcgtgacgctgaaagctgaagccggtgttgagaaggtcaattacctgtcgcgggaagaggcgatgggtgagttccgcaactggtctggttttggcggtgcgctggatatgctggaagagaatccgttacctgccgtcgctattattactcccaagttaaatttccaaagtgctgaaacgctgaatacattgcgtgatcgcattagccaggttgaaggggtggcggaagtccgtatggacgacagctggtttgcccgtttagcggcactgacgggcttggtcggtcaggttgcagcaatggttggtgtactgatggtggtcgctgtattcctggtgatcggtaacagcgtcaggctgagtatctttagccgtcgggatacgatcaacgtcatgaagttacttggtgctactgatgggttcattttacggccattcttgaatggcggtgcgatgttagggttcggtggtgcggtattatcgttgatactgtcagaggcattggtatggcaattggggtcagttgtcaaacaggtggcgaccgtgtttggtacccaatttactctgcatggcctgagttgggatgaaagcctgttactggtattaatctcggcaatgattggctggattgccgcgtggttggcgacggttcaacatttacgccgatttacaccgcagtaaagaatgtttgttatactcttcccctatcgtgctgaaatcaggtagggagagagtcgctgttcagtcattgacgatgtctattcataccatcggttttctttgatgcatatggtcaaattaatagatatggttagcgatctgctaagatccacagtccaaaaacgtgatctagattgaacttttaaagcaatgctcagtcgaatattgcagcaaaatgataagttgctcagcgcttgaatctgtataaccaggtgctaaaatattagcgctgagagaaacctgcactaaacatgcaactgagagggtttaaatgaccaaagaaatgcaaactttagccttagtgccccagggtagtctggaagcctatattcgggctgccaatgcctatccaatgctaactgcagaggaagaacgggagctggctgaacggctgcattaccagggcgatctgggagcggctaaacagcttatcctgtctcacctgcgctttgttgctcatgttgcccgcaactattccgggtacggtttgccacaagctgaccttattcaggaaggtaatattggcttgatgaaagcggttcgccgttttaaccctgaagtcggggtgcgtctggtgtcctttgcggttcactggatcaaagcagaaattcatgaatatgttctgcgtaactggcggattgtgaaggttgcaactaccaaagctcagcgtaagctgttcttcaacctgcgtaaaaccaagcagcgcctgggctggtttaatcaggacgaagtagaattggtcgccaaagagcttggcgtgaccagtaaagacgttcgcgagatggagtcacgcatgtccgctcaggatatgacgttcgatccttctcctgatgatgaagcacgtgacggccaattcatggccccagtcctgtatttgcaggataaaacctctgattttgctgatggcatcgaagaggataactgggacagccacgcagcagataaactgtcttatgcgttggaagggttggacgagcggagccaacatattattcgcgcccgttggctggacgatgagaacaagtccaccttacaagaactggccgatcagtacggtgtgtctgctgaacgtgtacgtcagcttgaaaagaacgcgatgaaaaaattgcgtatggcgattgaagcctgatacaacaaacagacagatgctgtaatccggcacgataaagaagggcgatattgattatcgcccttttgctttttggcagatatggacgattaccgtttggtagctccgcagctaacgtcggcaactatcgtccgcgccgactgttcgtaatgactgtctgcggcctaccgttcgctgctacggttcatcattattgtccgcgcggcttaccgccgccagccttgtgcttcatggctaaatccacacgcgagcataaagctatttatctgagggcgctcggcagccgtgagatccccgccgttcaggtaccaatgtttaatttccggtaactgacgcagcgtttcctcgatcagatacaaccccacacctcggcgacgcgtcacttctctgacacacaaatcctgtagttcagcctgttggtcatataccgccactttaactgcacctaacaaacgttcattaaaacgtgcagcaaaaagtggtctaccctcagtaatccactgttgccaggcagcaggctgttgattcggccagattttagctaaatctataacatcctgatgagtaagggttattagtcgttcaatcgtcagtttcatcgcgagaagccatagtaataaagtggatatagcgccgaggttcattgtactagaacacagaccagagagctgtgtaagtttttctgtacgtccacggggggaaatgttttttcgctactgcgttttccgagttttaccggagtaaatgatcacataaccagcacaacacactatcaattgttaaaaaaccattcaattcacacctaattttatgctgtttacaccgcttgtttctgcttgtcttagttgatttgcagcataaaactcctgtttaatggtatgaaaaataaagtcttattagaaaaaataaagactttcaaggttaaatcattattacttatgaacaaaatgttacattaatgctaaaacactcagacaaacacaacaagcatgttcacaatgacagatggggaattcgcggatgaaattaacaaaaggtaaagcgttgctggctgggtgtatggcaatggcgatgagtcattctgtgctcgcgcaagacattaaggtcgctattgtgggggcaatgtccggcccggtggcccaatacggtgacatgcaatttaccggtgcgcgccaggctatcgccgatatcaacgctagcggtggtattaaaggcgataagctggttggtgtggaatacgatgatgcctgcgatccgaaacaagccgtggctgtcgcgaacaaagtaataaacgatggtatccgttatgtgatcggccatctgtgctcttcttcaactcagccagcttcagatatttatgaagatgaaggggtgataatgatcacccctgctgctacaaacgcggatctgaccacccgtggttacaaaatgattatgcgcaccaccggcctggattcagaccagggccctactgctgccaaatatattgttgagacgattaaacctaaacgtatcgctgtggtacatgataaacagcaatacggtgaaggtctggcacgttccgtgcgcgacagtctgaaagaacaaggtgcagaggttgtgctgtttgaaggtgtgaccgcaggggataaagatttctcgactctggttgctcgcctgaagaaagagaacgtcgattttgtttatttcggcggttactacccagaaatgggccaaattctgcgtcaggctaagcaagcaggcctaaccgcccgctttatggggccagaaggtgtgggtaactcctcactctccaacatcgcgggtgaggcctctgaaggcatgctggtgacattacctaagcgttatgatcaggttccggcgaaccaacctattgttgatgcgctaaaagcgaaaaaactggatccaacaggcccatttgtgtggaccacttatgctgcgctgcaatcactgacgacggcgatggaacgtactggcagcaaagaaccggctgatttggctaacgatctgaaaaccggcaaaccggttgagaccgtgatggggccattgagctgggacgataaaggcgatttgaaagggtttgagtttggtatttttgaatggcatgcggctggttcctctaccgcagtcaaataacaagaatagtagaactattgacaagaatagtagaactatctcgttttaggattgctctcgcagtaatccggccccttctatcaactgcatcccctcgtattccggggggatttttccctctacagcgtagattgggacagtgactagggcagccaggcaagtgaatcaaagggttagggtatgtcagagcagtttttatattttctgcagcagatgttcaacggtattacgttgggcagcacttatgcgctgatcgccattggttataccatggtgtacggcattatcggcatgatcaactttgctcacggcgaagtatatatgatcagcagttacgtctcatttatcgtgatcgccgcattaatgatggtggggatcgatgccagttggctgttgattggttgcgctttcctggtgtcgattgtgatcgccagtacttacggctggagcattgaacgggtagcctataagccagttcgtcgctctaagcgcctgatcgcgctgatttcggcgatcggcatgtctattttcctacagaactatgtcagcttgacgcaaggttcacgggatttggcattacccagtctggtcaccgggcagtggaccttaggtgagagtaatggctttgctgcgacgatcagcaccatgcagctgacgatttggattgtcaccttcttggccatgttggcgctgactctgtttatccgttattcacgaatgggccgtgcttgccgcgcctgtgccgaagatttgaaaatggccagtttactgggcattaacactgaccgggttatctcgctgacttttgtgattggcgcactgatggccgctgtcgcgggtgtgttactcggccagttctacggggtgatcaatccctatattggctttatggcagggatgaaagcattcactgccgcagtattaggcggtattggcagtattccgggcgcaatgattggtggtttggttctcggtgtggctgaagcactgacctccgcttatctcagcactgaatacaaagatgcggtttcattcgcgctgctgattgtggtgttgttagtgatgcctaccgggattttaggccgtccggaggttgaaaaagtatgaaacagctcaacttcgttaatgccattatttccagctttgtgttactggtcctcgcctcgtttgtgatggggttgcagttgcagttagacggtacccgattggtggtacaaggtgcttcggaagtccgttggttgtggattggtgccggttgtctggtggttttttgcttccaactggtacgcccgctcatacaacaagggattaaaaaagtctcaggcccggcgtgggtgctgcccagttttgatggcaccacaccgcggcaaaaactcttggcagccgtggttattatcgccgcagttgcctggccgtttttagtctctcgcggctctgtcgatatcgccaccctaacgctgatttacgtcatgttggggctgggattgaatgtcgtcgtcgggctatcaggcctgctggtactgggttacggcggtttttatgccattggtgcctatacttacgcgctgctaaatcactattacggtttaggattttgggaaagcctaccgctggccgggataaccgccgcgctatcaggcttcctgctaggcttcccggtactgcgtttacgtggggattatctggccattgtgacactgggctttggtgagattgtgcgtattttactgctcaataacactgagatcaccggggggccgaatggcatcagccaaatccctaaaccaacgctgtttggtttggaatttagccgcacggcgaaagatggcggttgggataccttccataacttctttggcctgacttacgatcccagccaccgcatcattttcctgtatctggtggcgttattattggtgatcctgacgctgttcgtcattaaccggttactgcgtatgccgctgggccgtgcgtgggaagcactgcgtgaagatgaaatcgcctgccgctcactgggtctcagcccgaccaaaattaagctgacggcatttaccatcagcgcggcctttgcaggttttgccggtaccttgtttgctgcccggcaggggtttgtcagcccagagtctttcacctttgttgaatcggctttcgttctggcgatagtggtgctaggcgggatgggatcgcagtttgcagtcattttggctgccgtgttgctcgttgtttcgcgcgaattaatgcgagatctcaacgcttacagcatgttgctattgggggcgttaatggtcttgatgatgatctggcggccgcaagggttattgccgatgaaacggccacaactgaagctaaaagttgctgatgtaaaggctaagcagggagagcaggcatgaatgggcaacctttgttaacagtcgaagggctgtcgatgcgttttggtggattactggcggtcaataacgttggcttgacgttgaatcagggggagattgtctcgctgattggcccgaacggggccggtaaaaccacgatctttaactgcctgaccgggttttatcgtccgacaggcggcaccattaagctacgtgaacgccatcttgaaggattaccgggccagatgattgcccgcatgggggtgattcggactttccaacatgtgcgtttgtttcgcgaaatgacggttatcgagaacttgctggtggcgcaacatcagcacctcaagagcgggatttttgcgggtttgctgaaaacccccggttttcgccgggcggaagcggatgcactggcgcgagcggcaacttggctggagcgggtagggctattagcgctggcaaaccgtcaggcagggaatttagcctacggtcagcaacgacggctggaaatcgcccgctgcatggtgacacgccccgagttattgatgctggatgaacccgctgcaggtctgaacccgaaagagaccgatgaattgaatcagctgattatggagctacgtgatcaacatcaggtctcggtactgttgattgagcatgatatgaagctggtgatgggtatttctgaccgaatttatgtggtgaatcagggaacgccgttggcacaaggcatacctgcagaaatccgtaacaatccggatgtgatccgagcctatttgggtgaataacgtatttttggtaaatggaaagcgggcgaggcataaacaataacatgttgtcatttaatcaagtttcagcccattacggcaaaattcaggcattgcaccaggtcagtttacatattcagcaaggcgaaattgtgacactgattggggccaatggtgcgggcaaaaccacattattggggaccttatgtggtgagcctcgagccactgagggcaatattgtctttggtgaacaagatatcacccactggcagactgcacggattatgcgcgaagctatcgcgattgtccctgagggccggcgggttttctctcgcatgaccgtagaagaaaatctggcgatgggcggtttttttgctgatcgtcagcaatatcagcagcggatcgaacgggtttatgatttgttcccacggctgttcgagcggcgtatccagcgggcaggaaccatgtctggtggtgaacaacagatgttggcaataggccgggcgttgatgagccagcccaaattgctgctactggatgaaccgtcactgggattagcgccaattatcattttgcaaatattcgataccattcaacaactgcgggaagaaggaatgaccatctttttagtggagcagaatgcgaatcaggccctgaaattggctgaccgtggttatgtgttggagaatggccgtattgttttggaagataccggcgcagctttgcttgcgaatgaagcggtgcggtcagcttatcttggtggctaatatcccccttcgtccttgacgttgcaggggcgttagcgacgttcgttactcggatcttgatgtttcgcgcaaggcgcaggaggggcggttttgccctccagcttcccgaccgacaaggctaataatattccaaaagatagctcatcgattcaatataaagcctgatgccactctcgtctgcataggcttagtatctatccttcactgcactttaaaaaggataggttatgattggtggtacaagtaacacaatggacttacatggattatctgcagtttgttccttcgcttttttgacagcagacttaatgctaaatattactaataagaacggagataatcacgaatataaagtgaccagttcccatgtgaataacgataaattacaaggcccaaaaggaattttaaaagccacaaaaaatcacgcagaactcaataataaaaatattgcttccggcgaaaaaaatgcgattaaatttgaccagctgcacgttagagaaatacctaatagagagcaagctagctatatcgacaatctcagccttaaccgtaatatttacttagatacccgtgctgatcgcgaatgtcgtattcccacccaggttattagccctgttcaaaaagtagattctggtaccaaagagccatcctggttcagtaaatacctttgtattactacgttatattaactctatttatacccattatatttcgagttgcctatgcgttgattgctctgttgcaactcgaattattgagtgttcagcttattgataatctaacgattaataacgtcattgagattaggctaacggcgtgatagtaaaattcagcgtatccgtgtagtgacctttatcggtggtatcggtactgtaaacccgaatgcggggtgaccagcacatctgtgcttcgccgccgctgctagtatcactctttagctgaacaaactttttctctttgggtagtgaaaaatcagcctcgctatcctcatgatttttcagtgtgaccttgtagttgatgatgtgctccccttggttatcttttaactgaaaatagcgactactctcagctaacccattgagattactggcactgatcatataacgccgattttgtatacctaccgatgagtaatggatacaaaaacggttagccggggcgttaactaatggcgcatgtaacccatggttatcagccgtgctatcgagtaaatgatctagatcgagggattttagctgccatattgctgatcccagccggaatttaggctcgatatataaagcatgggccggtgctatctctgttgtggggtcaaagaattcgcattgattacctgattgattaaaagccacgccattgggggagcgtacagaatactgctgcccttctgaatggagcacaccgccaatggtggcacccattctaatatgtttaagtgtgcttaccgcaaggctgaatgacacgtgataactttggtttgaaaaggccggtgtgctaacaaagatggcctcgcggatatagttgctaatatgttgagcagggacgccattgagggacatgtcctgaacctcccctgattgcagactaaagtcgattgaaccgtcggctcgataaaaatagagataaagtaacgccttattctgtgccaacataatgtgttgctgcgagcgagttagctcttgccaacgttgaagatggtcgctattactaatatcaaataaatgatctgccagtgtgacatcgaaagaaacagtaagatggttatcttctgatagcgtcattttgcaattcgaatacttactggctagcgggtaaaaataaattccggcccatttgttagctacggcagttgtgggctgtaggaataacagcaataacccgataaacaatgatttattttttatattcatttaatggtctctccgtgacgattaacgattaacgattaacgattaacgattaacgattaacgattaacgattaacgattaacgattaacgattaacgattaacgattaacgattaacgattaacgattaacgattaacgattaacaattaacaattaacaattaacaattaacaattaacaattaacaattaacaattaacaattaacaattaactattaactattaactattaacttcgaataccaatgtcagttgcccgtgatatttccctgcagtattgtcccctgcgggggcttttgcggatatatgtaagacataatcggtggtggtgtggcgggttgcctgtggaggtacgctaaaggactccggtaccgctgacagtaaacgtaaattggtgcggttatttccccaacgcacttccgccggtgagaatgtctgttctattgcgctgaaagcatctgattggcgggtgagtattagcgggtttttaattgagatttgatacccctcttgccgccggagtttgacggctaccgggacttctacctcataaacggcatggttctccgggctattgtgcagcttgatattgtcgtaccagccaccatgcggtttttcgatttcgattctgggttgggctgttacctctaatttgacgtcgatatcccccaatggcgttgcggcccagcaggtgtgccatgagagcaatagcaatgtgatggccatttttatggtattcatgtttctggtttgtccttcttattgatgctgataaatttgttgatagcttattaccaagaggctagcccgaagggcactgtaggctaaccgcctgatcctctacttttccttgcaactcattgaaagctaactgccgatgctggccggggtagagcgtaaaatcgtctatcatttgcccctgtgcttgcagttgatgccagtacaggcgggtattgccggtattgtgtaattcaggtttccccgcgatacaacggtgtgtccattgatgttgtatcgatgctggcaggtgcctgataagccccatataactgatctgcacacccacgacagccgtattattgccactgattttcaggtggttgcctggtaccacggctaaccgataaacctgctcttgttccggtgcccctaaggcatgtagaaaaattttcccactctgtcgagggcctagtgtcagtttcagcggtgtggcaaaaagtaagggctgctgctggtagccaacaggggtcagcgattccaattcaggggcgacaccagggttattcaatcgatataactgcaccgtaatatattcagcagtcatgccatggttgatcacggtaaccacagtattctcctgctgtaattccacgacctgtggctgaatatcgatcacgccagcggcactgagcggcaagaggctaatggcagcgaagactaaatttttcaccgtccacctcaccattgagttgtttgacgggcagtgtgagcgcggtgcccggatacagatttagactgtcggccagtgcggggttaccacccgattcgagctgcttaaacttactgtgcaccgttccggtagcggtgagtgctagctcgccagtagctgagcattgatgttgccaatgacgagtttgtgccgccgccggtggcaaatgatgaatcagcacgccataaccaatactgatggtcattggggcatgaactttacttttatcctccccatcgccaaccgctttgatattgagcacggggttgatatacaggcggtaaagggtttcctgtaccggcgatttgagtgggatcagcgtaatatcccgcttttgtctcggccctaacgtaatgcggttaggattaaaaatcatttcaggctgagagatttcactgatgggtgttttacgctcggggttcacgcctgggttatccacacgttgtaatgtgatatccagataaagcggtgtatcgccgctgttatacacctgtacggttcgcttctgctcttgtgcctctaccgcaatacgggtgggggtagcaagcagttggccgtaagtggcagtaccaggggccagtaacagcgcgatgctgagtatcgaataaaggtatttcatgaggattcctatcggtattaatcggcgtggcaaaggtaaatatgagtaggttgcgaatgcatatcacagcggtaacggccagaagggccttggacggttatcgcttgcagcctattttgggcgttaatggaaaacagcccattgggataagcggtatcacccgtctcctcaatcaccccgctcaccggtagcccttgtgcatttttgagaaaaccgctgtatagcaggttcaatgtgatgtcagctttgcctgaaaaaacttgcccagggtgagcgcgtacgatattgaccggcagttgaatattcatatccatatcactgcggtcggtgtgagtacggacaaagaaacggtcttggtagcgggggaccggtatcgcatagatgccaccaccggttattgggctatcctccacatgaaaactatagggggtgccgcccagagcgggggctttgatcaagagtgccgctccgctataactgctgcgccccaaggcaaccccctgtgagctgagtgccaacatgccgttatagctaatccccccgttggttatctggttatcaatgcctacccggccagagatatccccccggctcccgctgcgtttagcaaaaccgccgacgctatttagtttcccgctggcactaccgctgacacccaaagtgctggccccatagttatcaataaactctttctggtaactggcgctggtattcaactgttgttgggtataagccgtattgatgctggcgttactttggccgaaggacagggtggtgttcaggaagacgccgtaattattgtgactgttccattgcccaccattttgcagcccaagggataacgcgaggttaaattgtggtaattgccagtcccaaccactttggatacggtgctgccggttattgcggtactgattgaattgataacttagctgggttggcccaatacgccgggtataggagcctgaggtactgcctgagtcaggtgcgtatcgcgagacataaggtgactgatagcgagctaatgaaaagtaacccagtgtattgttgccaccatttaagcgaacgtaacctccactgcgtttctctcctgacatcaagccccctgttggggtgatattcaccttattgaggcttaaagggcgtgagacgttcgcttccacggcccagtgatgggcatcatctttaagtagcgtgatattggtttgtacgctttctatcaccctgctgcgtccaaattggactaaacggggcgtttttttaccctttgcaggccctttgcccattgtcagaaaccaaccattattggtctgattgccaatattgctgatggtttggttttcctggctgacgatccgcccaagacgatcaactaaacgaatctcaacgttgtaatagccccctggtagttggctgtaatctatctcgttgcgacccaattgagcggggatgcggcgaatgagctgattatcgcggtatatttcgtagtcaccatcttgagcggcatagagcacgatactgccggtggaaggcttatcgatggccagatagctttgactaccgagtgttacaaattggtccaacgcagggttgatcagggtgtgaacgctacctgcgttgttatccaggttgttttgccgaccggtgcgtaaatagagtgccgagaagttcttttgcaaataccaactgccgatccctttttgggttaggcgctgatattgagggcgattaactggctgataggtgctctgcgatggcatggtgttctgtgattgcagcgtattttgtgactgaatcgcgttataaaaccaagatgcaaagccataagattgccatggcaagccgatgtaactttgaccacggactgacatcgcccgatagtgggctgctgtcattcgcaaatcgagagattgattgctgaccaacccccatgtcgtggttggcatcagataacgattattattattggtgatcgtcaatgtgttattcactttatctaacgccacgcggtgacccgataaagtataatcacagccggttttacactgtaaatacggtatttgagataatatcttacccaataaaataatagattcttcactaatattattatgccgatcgttctgttgattaaattgcagttgttgtttttcttctgagaaggtaataggactgggcaatgtcttactgtctaatacccctaataactgaagtgagttgttctcttcagccgcggaaaaccccattggcactaaatactctattttaactgcttctgcatgagcgagctttagtgtgaataaggctaaagtaaaaagtaagctatgattaatttttgaataataggccataggattccattccactataattatggtggttttacaggataattatttatttttaaaagaaataatttgtgtatatatccaaaataattcgaattgcaggaagtcgacaactgagtaagtccccaggagcttacaccagtaagtgactggggtgagcgaaggcggtcaacgcacatgcagcttgaaatatgacggatatatacagccaggaaataattccatggctgtattcattaaattaacaaactgtattgaaacgaactaaattaagcgcttggttccagacgtaactgaattaccccgctatatttttcaccaccgacggcattattaggctctttggcgctgactttcagttctgcgttgagctcagagccatggaaggcaatcaggtctcgtgtgtcggccgtctcaagcagcttcttcccatctaacaatacttcaacgtgagtaaactctttattgttatttggctcgcttaagataaccggtgcggcaagagacacttttagcttatctccgagttgtttacgtgcttttactttaattgcttctgaatggctatacgtaccatcattcgttaccgtgtcataggttaattttattttattaatattgctatcatcagctctcttcacgtccatgagagaaataatttctgcttcaacacgaatatctttctctattgtgtttgcataagccgcagtgctggtcaatgtggccatagtgataatagcaataacagttttcttcatcataaatacctgatagtcctttatgtaaaaacccatccaaaatggaatggcattgtgatttattagggttgatgttggtggcgtaatataaaatgagggtgttaaataattacacgacattatgcccgtcacaaaccggggcgaacactaacatgacaaataacgttatttcaagtggtaattataccattttgtctgaatgattttaatttatatcaccttaaggaataaatacttaattgttatagttagtattaattgttagcggtctcctttaatttatcgactaactaactgttattttttattttacttgatgattctattggtaatgaaaaaataaaatagaattaaaaggttactttcatttcattgttaattttttgtacacattacagatgctttattttcattaaattgccgtatttctgtcatataattgttatatttctgtcatgaaaagatgtcatgtttgcttccgaacaaaaactgatttatttcgctcattcacacttattttttgatgtgagccacacagatttattcaggggccagatatgtttaataattccattcataaagtgtcgatctgtatcgcgctaacacttacgtttagtgccaatgcgatggcagtgactgaaattcctttttggcattcgatggaaggagaattaggtaaagaagtcgattcaattgcggatcgttttaaccagtcgcagcccgattataaaattgttcctgtttataaaggtaattacgagcagagtttggccgcaggtattgcggcattccgttcaggtaaggcaccggctattttacaagtctatgaagtcggtactgccaccatgatggccagtaaggcgatcaaaccggtttaccaagtcttcaaagatgccaatattgattttgatgagtccgtcttcgttccaacagtggcaggctattacactgattctaaaactgggcgtttattgtctcagccgtttaacagctcgacccccgtgctgtattacaacaaagaggctttcaaaaaagcgggcttggacccagaacaaccgccaaaaacatggcaagaactggcagcagataccgctaagctacgcgctgcgggttctagttgcggttatgccagcggttggcaagggtggattcaaattgagaacttcagtgcctggcatggtcagccgatagccagccgcaacaatggttttgacggcactgatgcggtattggaattcaataaacccttgcagatcaaacatatccaattactgtcggatatgaataaaaaaggcgatttcacctattttggccgtaaagatgaatctacgtccaagttctataacggtgattgcgctattaccaccgcctcttctggctccctcgccagtatccgccattatgccaagtttaatttcggtgttggcatgatgccgtatgacgcagatgcaaaaaatgcgccgcaaaacgccattattggtggtgctagcctgtgggtgatggatggcaaagataaagagacttacaagggtgtcgcagagttcttgcaatatttggtcaaaccagagattgccgctgaatggcatcagaagacgggttatctgcccatcacgacggcggcatatgaactaacgaaacaacaaggtttttatgagcagaacccaggcgctgatgtagcgacccgccagatgctgaataaaccgccattgccttataccaaaggcctgcgtctcggcaatatgccgcagatccgtaccgtggttgatgaagagctggaagccgtatggaccggtaagaagacgcctcaggcggcattggataactctgtgaagcggggtgatgtgttactgcgtcgttttgaacaagccaataaataacgttatttggctacggtagctgcccgtttgatattgggcagagctcggtctactcgcgtaatgcacttggttttataacaacgggtgtatacaccggaaccgatgcgctgcccataacaaaaccaaactgactgtatttgtaacaagcctatggtttgtaacgaataaataaatggtttgtaacgaataaatggtttgtgacgaaaaatagtttgtgcgctattgagttaagaagtcactttttttgattaccaccttggtggtaatcagcacggcgtctgataaacggttaattttatgtcaccttctcgtcccggtttttcctgtagttggttaccttatctgttggtattacctcaattggcgatcaccgccatcttcttcttgtggcccgcgggtgaagcgctgtggtattcagtgcaaacgctggatccattcggtctctccagtgaatttgtcgggctgagtaattttattcagctatttcaggatgagtactatctggcttcgttttataccacgctaatttttagcgcgttggttgcggggatcggcctgaacgtttcgctgtttttggccgcaatggtggattacgttctacgtggcagccgtctttaccaaactttattgatcctcccttatgcggtcgccccggcggttgcggccgtgctctggatcttcttgtttgaccctggattgggtctgataacccatgctctggctaagttgggttatagctggaaccatgcgcaaaacagcggccaggcgatgtttttggtggtgttagcctcggtatggaagcaaatcagctacaactttttattctttctggccgcgctgcaatctataccaaaatcactggttgaggctgccgccattgacggtgccgggccggtacgccgtttcttcaatttggtattgccgttgatttcacccgtcagcttcttcctgctggtggtgaatctggtttatgccttctttgatactttcccggtgattgacgccgctactggcggtggcccagtacaagctaccaccacgctgatttataaaatttaccgcgaaggtttcgccgggttggatttatccagctccgctgcccagtcggtgatcctaatgttactggtgattggcctgacggttatccagttccgctttgttgagcgtaaggtgcgttactaatgatcgagaatcgtcgtggattggatatcttttgtcacatcatgctgattatcggggtgctattgatcctgttcccactgtatgtggcgttcgttgcggcttcattagatgacagccaggtttttcaggcgcccatgacgctgatccctggcccgcatttgtggcaaaacatcagccatatctggcatgccggcgtgggcaataacagcacacctttcgggttgatgctgttgaacagttttgttatggcttttgccattactgtcggcaaaatcactgtctcaatattgtctgcttatgccatcgtttacttccgtttcccactgcggaatctgtttttctggctaatcttcctcacgctgatgctaccggtggaagtgcgtattttccctaccattgaggtgattgccaacctgaacctgctagacagctataccggtttaacattgccgctgatggcctctgccacggcgacgttcttattccgccagttctttatgacgttgccggatgagctattggaagccgcccgtattgacggcgccggtgccatgcgtttcttctgggacattgtattaccgctgtcaaaaaccaatctcgcagcattatttgttattacctttatttatggctggaaccaatacctttggccgatcttaatcaccagtgatgcctcaatgggcacggcagtggcggggataagaagcatgatttcaacctcgggcgcaccaacccaatggaatcaggttatggcggcgatgattttgactttaattccaccggtcgtggtggttcttttgatgcagcgttggtttgtacgcggcttggtagacagtgagaagtaatctgatatggcatgtttaaaattacaggcagtaaccaaatcttatgacggcgtgacgccagtgattaagcagattgatttggatgtcgccgatggcgaattcatcgtgatggtcggtccgtccgggtgtggtaaatcaacgctgttacgcatggtcgcggggttagaacgcacgaccactggggatatctatatcggggatcagcgggtaaccgatctggaacctaaagaccgtggtatcgcgatggtatttcagaattacgcgctttatccccatatgaacgtattcgataacatggcttatggcctaaaaatccggggttttggcaaagaacagatccgccaacgggtggatgaagcggcacgtattctggagttgcagccgctactgaaacgcaaaccgcgtgagttatccggtggtcagcggcagcgggtagcgatggggcgtgccattgtgcgcgagcccgcagttttcttatttgatgagccgctctctaatctggatgccaagttacgggtgcagatgcgccttgaactgcaacaactgcaccgccgcctgaaaaccaccagtttgtatgtcacacatgatcaggttgaggccatgacattggcacagcgggtgattgtgatgaacaaaggggttgccgagcaaatcggtacccccagcgaggtttataaacggcctgcgtcactgtttgtcgccagttttatcggctcgcccgcgatgaatttattagacggtacggtcagcccagatgggcgcacgtttattttatccgatggtctgactctgccactggagatccctcagccacaatgggggggccggcgcttgactctaggtattcgcccggagcatattcagcagacaacctcagcgcagggtgtgccgatgaacctgctaacgctggaattattaggcgcagataatctggcgcacggcctgtggggcgggcaaagtattattgctcgcttatcccatgaagaaatgccagtggcaggcagtacattgcatttatatttaccgccagcagcgctgcacttctttgataccgatagcggactacggatagaaccatgaatagagactggccttaccctcctatcgttgcccatcggggtggcggatcactggcaccggaaaatacactggccgcaattgatgtcggtgcgcgctacggccataagatgatcgaatttgacgccaagctatcgcaggatgggcaaatctttttactgcatgatgacaccctagaacgtaccagcaatggctggggggtagcgggtgagttggcgtgggaaaaactgattcagctagatgcgggtgactggttcagcaaggcatttcgtggtgaacgcttacctttactctctgaagtagcggcgcgttgtgcgcagcacggtatggccgccaatatcgaaattaaaccgacaaccggcacggatgctccgactggccgggcgattgcgctcgccgctcgcgcattgtggcaagggcagccgatcccccccctgctgtcctctttttccgttgacgcgctggccgccgcgcaactcgctgcccctgagctaccacgcggattgttgctggataaatgggatgacaattgggcggcactgaccacacaacttgattgtgtttcgctgcatattaatcacaaacagctaacagcagaacgcgtggcgttactcaaagccgctgggttacgtattttggtctacacggtgaaccaacccgagcgggcgcgggaattactcaattggggcgttgactgtatctgtactgaccgtatagatttactgggttcggactttaccggctgctgaccttctcctataaagaccctcaatacccgccataataaaaacaggtcagccattcttacatttacgggctgacctggcccggcctgacaggaagtaaatcatgcccgcctttgttgtttcgctctggcaccaaatcgttttgtcttcaccgttatttgttttgctcgcactgggatatgctctggtgcgattcggtaagtggccatcgactattacggatggtctgactcgctttgttttctccctcgcgctgcctgccatgctatttcgcatgatgtgtgacttctccgaacgcccggcggttgatgctcgcctattgattgctttttttggcagttgtctggtggtgtttatcattgggcgggttatcgccaaacgggtgtttcatctggatggcgtttctggctcagtctttgccctcggtgggatcttttccaataacgtgatgctagggctacctattgccaccatcatgctgggggagaaatctatccctgcggtggccttggtgctggtatttaacgggctgatcttgtggacgctggtcaccatctcggtggagtgggcacgaaatggttcaccgacgatggctggttttgtgaaaacgacccgtagtgtgctgactaacccactcattatcgggattatttccggcaccttattcagcctgacggggttacatttaccggtgtttattgaccaaccggtcagtatgttagggcaggttgcacctccgctctcattgattgtcttgggcatggggctggcagaataccgcgtgaccgaaggttggcagattagtaccgctatctgctttctcaagttgattgtgcagccgatggtgatttgggcgctggcatgggcgatggatctgcccgcgctagaaactcaagtcgtggtgttgctggggtcgatggcaacgggggtgaatgtttatctgatgtcacgtcagtttaatgtcctcaccggccccgccgccgccagcctggtgatgtcaacggtactggccgccgtcaccacgccactgattctgaccattattggggtgggcatatagtgtgataggggtatgcaatgtgcagtggcccgttgggatgtctgtcacatcatgacaagaactcatatattggccttgatgccaaaacgaaaaaaaactaatataaaatccgcttaacgaaatcacggtatccaaaatgaaccaggtcgatgtgcagaaagacattagtgatttgattgttaacgccttcccaagggcgttatggctaaacatacaagatgtgtttcatgcgaaatatgaggccgcacagcaagtcactatggggtcagcactaaagcttgatggtccagggcaacttcggctaagacctcaaataagacattatactttgaatgcggcattcaaagaggcggccttgagttgtggggttattcataacagtgttgagacttcaccaaaaggtgagcattttgttgtcttaagttcggctggtgtcaaaatgagcaggattgggcttaactatgatgaacccaatatcaaaggtgctaagcatcggacgcttttagccgaactcaacgaaagcttggaagggtacacacctgatttatttagcgaaagaaccatagaccatgggccaacaggaacgttaggtgtcttaattctaaatatcaatccaccttatcatgaaccacagagcaggatgctcgatttaagggttgtggtacctttcagtaatttgaaaggattccattttaattggtcattaactcaacttttagagcggtatactggtgagcaaaaaattatcattcctgataatgtcttgcctacactaaaacggcatctgaaagatcaagaaaattaagtcggcggtactatgagagtgggaatatctggatttcagccagaaagactaacccaaatgcgagaagctcgagggttatccaaaataaacttgggtaggttggttgaacgttccccatcaacaataacaaaatgggagaacggcagtcattctcctgatgcagagggccttgccagtctcggcaaggttttaaattgccctgtgagttggtttaccaaagttgcttatgaaagagaaaataatcccgttttctttagaacattgtcggcgacggccaaagatttgtgtaaatcgtcagaagtttatatgggatggttacaagagatatctgcatcattacaggaatatttagattatccaaatgtcaatattccgtacttagatgttgatgattataggtccattgatgatgaagccatcgaacgggtagcttctgattgtagaaagagatggggactcggtattgcaccgatccaagacctattattggtcatggaaaatgcaggggtagtatgttctcggtttgaacaaggtagcgtaatgatggatgggtattctcaatggaatgagaaagaaaatagaccttatgtcgtattggcgagtgataaaaataattattttcgcagccgatttgatgcagcccatgaactcggccatttggttttacatcgatacgtaaaacgccttgatagtattaattttaagccgattgaagagcaagcccataaatttgctgcctgttttatgctacctgaagaggctttttctgcggaattaccctcttttccaagtttggaaaattttgtctcacttaaaagtcgttggggcatgtcagcacaatcaatgattttgagagcgcgtgatcttgagcttatatcttctatagaatatcagcggttatacaaaagcctttcatctcgggggtggcgtaaaggtgagcccttagatgatcagcgtaagccggagtcggtgaggctgttgcccagatgtattaatctattacttgaatctactattttttcaaaacacggctttcttgagtttgttaatttggcgcgaggcgatgttgaagatctatgctcattacctaaaggttttttagcagaatcagcggtacttagctttgaatcaaaaatacagttaaagaatagtgtaaaaacccttcctgaaattgatcatcgaaccaatgtagtcgacatgtttgatcgtcgctaaaccgcaatctctattatgttgtgctattttcctggaatgagaaatggcacaacaagtcagtctgccgagagagaaaaaagagccaataagttcgaaaaaatcactaaatagatttaatttcaaccatatgtaaacgaaattattgggaaatttctatactgcttccgctacaattgcattttaccctctcactgagccaatttattgtgttgctactggtcattaccactatcttgtgggctttctcttttagtctgattggcgaatatttagcagggcaggtggacagttggttctctgttctgatgcgtgtcgggctggccgcactggtctttttgccttttctgcgttggcgaaatatcccctggcgggtgatcctgctgtatatggcggtggggtcaatccaattaggtatcatgtatttattcagcttccgagcgtatctatatcttacggtcccggaatttttgctgtttaccgtgatgaccccgctgtatgtcaccttgatttatgatttgctgcgccgacagcgcctacgttggggttatgctctcagtgcgttactcgcggtgctaggggctgccattattcgctatgatcaactgagtgaacacttttggtggggattggcactggtgcaggcagcaaatatctgttttgccattgggcaagtcggttacaaacggttgatggaggtccacccgatcccacaacatgtcgcattctcatggttctatcttggcgcctttgttgttgctgtcgttgcctggtttgcatttggcaatccacagagactaccaaccacgggattacagtggggaatactcgtctggctgggtgtcggcgcttccgcactgggctattttatgtggaattatggcgcaacacaggtagatgccggcacactcggcatcatgaataatgtacatgttccggctgggctactggtgaatctggccatctggcaagaaaaaccgcattggcccagctttatcattggagctgcggtgataatggcttcgctgtgggtacaccggcgttggatcgcaccgcatcctttacaaacggcaaatgatcgcaagcgtgctgacgagcagaacgaataaacgcttcagtgactggttggcgctgttctccatcacggacggcagcgtataaccggctccacaacccttctcccagcgtcttagtgacaaccaatccttggcgctcaaagctctccaccacccagtgaggcaatgccgcgatacccatccgtgctgataccatctggatcagcagcaatgtgttatccacatttttcaacgatgggctgacgcctgcgggttgcaggaagtgccgccaaacatccagccgctgtcgctgtaccggataaatcatcaatacttctggcgctaaatcttctggttcaatgcggtctttattggctaacggatggtccggagccaataccaggcgcacttcaaaatcaaacatcggtgaatagtgcaggccactgcgcggcaaaatatccgatgtcagcaccagatccagttccccttgctgtaatgcgggttgcgggtcaaaagtgacgcctgatttgaagtccatagtcacttgcggccagtgcttatggaaattatccaacgcgggtgtcagccactgaatgcagctgtggcactcgattgcgatgcgtaacgccgtttggtgtggctcattgcaggtttgcagtgcctgtttaatttgtggcagcacttgctctgccaattgtaacaaaatctccccctgcgtcgtgaaacgcagcggttggcttttgcgtacaaacaggcgaaatcccagacgctgttccagatcactaaattgatgggacagggccgattgggtctgatgaagttgcgttgccgccgctgccagcgagccagtattacgcaaagcttgcagggtgcgtaagtgtttcagttcgatcatgagagtccttcacagtgactgtgaaaaaaatgcgcttgtggaatatacagtacctgcggattatagatgtgtaaacatctggatggctaaatggggaataagacgatgacaattttaaatcacacactgggttttccgcgtgttggtctgaaacgtgaactgaagaaagcacaagaaagttactgggcaggcaactcaacacaggaagaattgctcaatgtggggcgtgaattgcgtgctcgccattggcaacagcaacaacaagcgggcgttgatttagtgccagtaggtgatttcgcttggtatgaccatgtcctgacaaccagcctgttgctgggtaacgttccagagcgccaccaaaatgctgatggctcgattgatatagacacgttgttccgtattggtcgtggccgtgctccaaccggtaagcccgcagcggctgccgagatgactaaatggtttaataccaactatcactacatggtgcctgagttccagcaaggccagcagtttaaactgggttggactcaactgctggatgaagtggacgaagcgctggccttgggccacaaaattaaacctgtgctgcttggcccgatcacttatctttggttgggtaaagtcaaaggtgagcagtttgatcgcctctcgctactgaacgatattttgccggtttaccagcaggtgttggctgaattagcgaagcggggaatcgagtgggtgcagattgatgagccagcactggttctggaattaccacaagagtggttggatgcctatcaaccggcttatcaggccctgcaaggtcaggtcaaattattgctgacaacttacttcgacagtatcggccataacatcgacactatccgcgctctgccagtgcaaggcttgcatgttgatgtggttgcgggtcatgacgatcttgctgttttgaataaaaatttaccaaaagagtggttgttatctctgggggtcattaatggccgtaacgtatggcgtgctgacctgagtagttggtttgaacgtctgcagccattggttaatagccgcccgctgtggttgggtagctcatgctccttattgcacagcccgattgatttaaatgaagagacccgtcttgatgcagaagtgaagagctggtttgccttcgccctgcaaaaatgtgctgagttagcgctgctaacacaagcattgaatgcacctaatgacgctaagctggcagaactggctgcgtacagtgcgccgatccgcgcccgtcgttcctccagccgcgtgcataatgcgcaagttgagcagcgtttagctgcgattacttcgcaggatattgagcgccaactgccttatgaagcacgtgctgaaactcagcgtaagcgttttaatttgcctgcctggccaaccacgaccattggttctttcccacaaacgacagagatccgtggtttacgccttgattttaaacaaggtcgtctggacggtaaaaactatcgcacagggatcagcgagcatatcaaacaagctattgctgaacaggaacgcttgggcctggacgtgctggttcacggtgaagcagaacgtaacgacatggtcgaatacttcggcgaacacttggatggttttgtctttacacaaaatggttgggtacagagctacggttcccgctgtgtgaaaccgccggtcatcattggtgatattagccgcccagaagcgattactgttgagtgggcgaaatatgctcaatccttaacagagaaaccggtaaaaggcatgcttaccggcccggtcactattctgtgctggtcgttcccgcgtgaagatgtcagccgtgagacgattgccaaacaaattgcgctggctttgcgtgacgaagtggaagatttagaaaaagcaggcattggtatcatccagattgatgaacctgcattacgtgaaggtttgcctctgcgccgtgctgactggcaagcctatctgcaatgggccgtcgacgcctttaaattgaatgccgctgtggcgcaaaacgatacacagatccatacccacatgtgttattgcgagttcaatgacatcatggattccattgccgcactggatgctgatgtgattaccatcgaaacctcccgctcagatatggaactgttggaatcatttgaagacttcgcttatccgaatgaaattggtcccggtgtttatgatattcattcaccgaatgtgccaagtgttgaatggattgaagcgttattacgcaaagccgctcaacgtattccggccgagcgtttgtgggtgaacccagattgtggtttgaaaacccgcggctggcctgagacgcgtcaggctctggcgaatatggtgctggcagcgcagcgtctgcgtgaagaacagatttaattaaaccgttttactctgtgtagtggggcttttggggcgctttcgcgcccttttttattgcgtttcttctggaatggggatggccgagacaccatgttgggtaaaccaatcaagcatacgttgccagccatcttgggccgactctgcatgatagcttgggcgatagtcggcattaaaagcatgcccagcctctggataaacaataatctcagcatcggcattcgcagcgcgtaatgcctggcgcatagtttcaatatgctctgctgggatactggtgtctttacctccatatagccccaacactggggcgcagagatcgatagcaacatcgaccggatatttcggtaggaataaggttttttcaccaaccaatttgccataccaggccacggccgccttcaactgtggattatgtgcggcatacaaccatgcgatacgcccgccccagcaaaatccggtaatggccaattttttggtgtccccaccgtggcgggatgcccaatgagcggtgtgatcgagatccaccaaaacctgacgatcagggactttttttaccagattattcactaaatcattaatattactatagtctttggcatcgccctgacgaaaatacaattcgggcgctatggctaaatagccctgtttggcgagccggcggcagatatcctgaatatgttcatgcacgccaaagatttcttgcacgacaatcaccacagggtatggccctgtatgttggtcaggtttagcaatataagcgggtagctcatcaccctgagaggggatcgttgtttccccacagtgaataccgtgggtttgtaacgaatgtagttggtcagtatggtgggccgttgccattaatggggttccggcgggtgtgaaaccgcccgctgcttgtctgagtctaaccagttgatccgttttcacaagtgatctccttacgatatgaggacgtgttcgcgggttgaaaacccccctaattttgctgctgccgagtttaactataggtaatctttgagattaatgagatcaggtttttgtcattaacgctattggataattcaagctgtaaatctgagcagtcagactaaccgcgagtaccaagatttaatgttggcgcgattcatgcctcggtaatgactcttcacagataaaatgaatgctatctttgtatttttgtacaaaaaatagactttcggtgttttatgtgtgatttaaatcacaattaaaatgtatttatgtaatcactttctctttcaaggtgacataaatcacgaaatggtgttcttattttgagtaaagtatttctctgtccctccctacaacatctctcatgaaaagaggagtctcacacatggctaaatccgacgtttttcacttgggcctcaccaaaaatgatctgcaaggagcgacgttggctatcgttcccggtgatccacaacgtgttgagaaaatcgctaaattaatggataacccagtacatctggcttctcatcgtgaatttacctcatggcgtgctgaattagatggcaaggctgtgattgtttgctctacggggatcgggggaccttctacctccattgccgtcgaggagttggcacagcttggcgtgcgcaccttcctacgtattgggacaacaggggctattcagccacatattaatgtcggggatgtattagtcaccactgcggcagtccgtttagacggtgccagcctacactttgcaccaatggagttcccggcggtggctgatttttcctgtacgacagcattggtcaatgccgctaaatcggtaggggcgacgactcacattgggattacggcctcttcagatactttctatccagggcaggagcgttacgataccttctctggccgtgttgttcgccacttcaaaggctccatggaagagtggcaatcgatgggagtgatgaattatgaaatggagtctgcaactttactgaccatgtgcgcgagtcagggcctgcgtgccggtatggtcgccggggttatagttaaccgcactcagcaagagatcccaaacgaagaaaccatgaaagccactgaaagccatgcggtaaaaattgtagtagaagccgctcgtcatctgctgtaatccagcgtttgatagaagtagagggtttgttctcgggtcagtttactggcccgttctttatttcatctgattatctgataaggtcacagctcttataacgaacaataataagaggaaaatatgacgatgacgaccttctctcatccctccctgatcccactggatggcggtattaactttcgtgatctcgggggtaaccttgccgctgatggccggcggataaagcccggcttgttatttcgttccggttcgcttgatcgcttgagtaccaacgattgtgattttctcagtcacagtaacgttacccaaattattgattaccgtgatgccgatgaagtacaggctaagccagatgttttatggccgggtgcccactatcacaatataccggccaacccgctcagtagtgaggtgaatgccaatctggaaaaattgactaacgagacattagccacatttgatgtccgtgcctttatgttcgagctttatcaccgcttaccttttaatagcttggcttatcagcaattggtcaatttattgcaaaattgtgcatcaacggaccctgtcgctagcagcgttgtgcatagtggcgatgtggtacatggcgatgtggtacatagcgatgtggtacatagaggtattgtacagcactgtgcggttggaaaagaccgcacgggtgtaggtgctgcgttggtactgtttgctttgggggctgatgaatctactgtgctggaagattatctgttgacggaaaccaccctgaagccttttcgtgagcatatgctggctgaattggcactaaaactgaatgatcaggctctggcgcaatttacatttgttctctctgccagagaagagtttattcaaactacgctgcggagcattcatgagcgttatggaagcagggagcgttggttaaagcatgagttcggtcttggcagtattgagcgtgaaaaactacagtcttattttttagagtaacgggttattttttatgacattcgttttttagcataatgcgttacctcttgccttttatttggtccaggctaagagttggagtcggtacccccgtattttctcgagtaacattcagcgcccgaggtcataagaccaccacagttttatggccccaagggcctcgcattggggccacacgcccgttgtctatactaatagtttctctccggcttatggcatgggcccaccactgggtgactctttttaaccgcttaatgatacaaactaccgcttaaccagttcgctgatatttctcttatggcgaggcgtatgtttacgcctgataaattccctggagagaatgctcatgcaacatgcgattacctttgttatcgcttccgcgtgtatccttacgatctgctaccgtttatacggtatcttttttgttcgtaaggtgctgcgcgtcgatgacagtgaagttaccccttcccatacctttgaagatggcaaagattacgttccgactaaaaagtgggtgaactttggtagccacttcgccgcaatcgcggcggcaggccccttggttggcccggtgttggctgctcaatacgggtatttacccggcttcttatggcttttgatcggttgtgttatcggcggtgccgtacacgatacggtcgtcttgtttgcctcaatgaaacatcaggggaaatccctgtcagaagtcgctaaatccgaacttggcccagttgctggctggtgtaccggcctggcgatgttgttcattatcactattaccatggccgggttatcgatggtggtcgtacatgctctggaacgtaacccttgggggactttcgcagtgttcatgaccatccctatcgccatctgtgttggcttgtgggaacgcatgactggcagcatgaaaggggcttcgtatgtgggtattgccgctatcatggtgtgcgtatttgtcggcccgtatattgaaggcacttggcttggtgaatggttaatgctgaaagctgatacggtcagtattattctgccaatgtatgctttctttgcaaccgcactgcctgtctggatgttgttaaccccacgtggttacctttccagctttatgaagatcggtgtgttcggtgcactgattgttggtgttgtcttcattaatcctgaaattcaattccctgcggttacgcagtttattcacggcggtggcccagttcttgcgggaccggtttggccgtttatctctattactattgcctgtggtgctatctctgggttccatgcctttatcggttcgggtacgacaccgaaacagattgataaatggagcgatatcttgcccgtcggttttggtgcgatgctggcagaatgtatggttggggttatggcccttatcgccgcaacctctttgcatcctgctgactactttgccattaactcctctgctgaagcctggagtgcgcttggtatggaggttgtgaacctgccaaaattgagtgaagaaattggtttggacctgtatggccgtaccggtggtgctgtcactctggctgtagggatgaccgatatcttcattcgtgtgccatggtttaatagtttggctgcttacttcttccaatttgttgttatgtttgaagcggtgtttatcctgactgcggttgattcaggtacccgtgttgcccgttatttactgcaagattttctgggcgatatctgggctccactgaaacggaccgattggttaccaggaacattggtttgtagtgttattgcctgtgcattgtggggttacctccttaactcaggtgatattaactctgtctgggcattgttcggagtatcgaaccaattaatggcttctgttggcttaatcattggtgccacgattatcctgcgcttggcgaccaagcgtgtgtatatgctgacctgtgttattcctctggcttacctgtttgtcacagtaaattacgccggctattggatgatcactcacgtgtactttaattcagcggctaaaggctacaacctgttcaatggtatcatctcaattatcatgatgaccttgggtgtaatcatcttgatctccgcgctgaggaaatggcgtgagctatggatccgcaggtctgctgagatggctggcaacaaagtggttactgccaacgcctgataccactgacttattgtgctaatttgtttaaacggctggaatcttctagccgtttattttttgttaagttatagctactgcattttgagtatgctgatatacccttcgtatttgacgttgcaggggtgttagcggctctcactcacccgaatcacttactgatgtaagttcatcgggattcgttcgtttgctgcctacctgcaacgccaactactttgggtggttcccttcgtatttgacgttgcaggggtgttagcggctctcactcactcgaatcactggcttgtcgttgaccttacagcgagtaagttcatcgggattcgttcgtttgctgcctacctgcaacgccaactactttgggtagttccctttttatttgacgttgcaggggtgttagcggctcttactcactcgaatcactggcttgtcgttgaccttacagcgaataagttcatcgggattcgttcgtttgctgcctacctgcaacgccaactactttgggtatagttcgactctatcaatcacaggacataagcgtgacctttaatgatgccattactaccaccattgattttgttcgcgtacatgaagcgtgggctataccgattgtctttattttggcttttggcgaatcattggcttttctctccctgttattgccagcaacagtcatcttacttgggttaggggcattgattggtgaaagtggcattcctttttggccaatctgggccgccgccgctacgggtgctttcttcggtgactgggcctcgtattgggtcggaattcattataaggaccgcgttgccaccttgtggccactctcccgaaatccccagttactggttcgaggccatgctttcttcgagcgttgggggttctttggggccttttttggccgtttcttcggcccgttgcgtgctatcgtccctctagtcgctggtatttgtgccatgcctcaacgctatttccaactggctaatattgcctcagctctgatttgggcttttggtattttggctccaggagcattcggcattcaatggctgtccaattggataggctaaccttatttttttgacgttattggtggctagcgggtgttcaacggttaatagttttaacctgtttcttatcctcaggggaacggttttttagcctgtttattatttatgcgcacagcttcgcaagatgagatgtaacgcaaaaacactctggacatccatacagtatcctcttaccttgactgacattagaggagcagggggataatcgtggatatcagtttattttatgggctgggtggctgtttggtcggggggctgatcgggtggctaattgccagtttgtcccagcagcgaacaaaagcacagcaagatattgaacggcgattactggagcaggcattacagcaggcacaacagagtattgctacattgcagatgactcaacaacgtaatgagcaacagttacggcaaagtgagttggaacaacgtaatttgcatagccaattagcggcaaatagcgaaaaattacagcagcttgctcattggcgtaatgaatgtgaacagcttaatcaagaattgcgggctcaaagggaaatcaatagtgcccaagaagcagaattacgtgaagtcaccatccgcttagaagaaactcgcttagccacagaagaaaagcagcgtttattacttaatagtgaacagcgactgaccactcagtttgagaatttggcaaaccgcatctttgagcaaacggggcgtcgggctgatgaacagaataagcaaagcttagatcgcctgctattacctttacgtgaacagcttgatggctttcgtcgtcaggttcaggatagctttgggcaagaagctcgggagcgtcatactctgactcacgaaattcggaacctgcaacaattgaatgcccagatggcgcgagaggcattgaatctgaccaaggctttgaaaggggataataaaacacagggtaactggggggaagtcgttctggccaaagtgcttgaagcctcagggttacgtgaggggcatgaatatcaaacacaggttagcgttaaaattgaccaaaccagtcgtatgcagccggatgtgattgttcgattaccccaaggcaaagatgtcgttattgacgctaaaatgtcattggttgcctatgaacgttattttaatagcgaagatgatgctgaacgtgaggttgcgttgaatgaacatttatcatcattacgtggccatatcaggatgctggggcgtaaagattaccagcaactccccggtttacgctccctcgattatgtgttgatgtttatcccggtagaacctgcatttttggtggctattgaccgccagcctgagttgatcaacgaagcactacaacacaatatcatgttggtcagccctaccacattactagtggctttgcgcactatcaccaatttgtggcgctacgagcatcaaagccaaaatgcgcaacgtattgctgaaagagccgccagactttatgacaaagtacgcttgtttgttgatgatatggcgtctttggggcaaagcctcgataaagcacagctaagctatcaccaggcaatgaataaactgtcccagggccgtggtaacctagttgggcaagtagagagttttcgcactctaggggtcgaggtaaagcggcctattagcccattactggcagaaaaagcctgcgcggagcatcaacctgagggtgatttagcgctatccgatgacgcagaatcaggggcatttccagagtaatttaattggcaccgcaaccagggggtgtggggctttcatcggagttctggtacacttcctcgaaagattgactgaaaagcaggcatagaaaatggtagatcaggagaaggaaaccacccattttggttttcgcaccgtagccaaagaacagaaagaaggcatggtggcagaagtttttcattccgtagcagctaaatacgatctaatgaatgacctgatgtcatttggtgttcatcgtatttggaagcgttttacggttgactgtagcggtgtccgtcgtggtcaacgcgtgttggatttagctggcggtactggcgatctgacagctaaattctcccgtttagtgggtgaacagggtgaagtcatcctggctgatatcaatgaatccatgttacggatggggcgtgaaaaactccgtgataaaggtattgtaggtaatgtcagctatgtacaggccaatgctgaagctttacctttccctgataattattttgactgtattaccatttcattcggtttgagaaatgtcaccgaaaaagaaaaggcattgcgttctatgtttcgggtgctgaagccaggtgggcgtctgctagttcttgagttttctaagccactcctcgaaccgttaagtaaagcctacgatgcctactccttccatatcttgcctaaaattggtgagcttgtggctcaggacgctgaaagttatcgctatctggcagaatctattcggatgcatcctgatcaagaaacactaaaaggtatgatggccgacgctgggtttgaaaacgtaacctattccaatttaaccggtggcattgttgcgttacatcggggctttaagttctaacaggaatatggctatgtcactaagaacactgatgctaaagccctttttattaaaaccaaggttactgacacccctaataaccgcagccttagaaacggttctcaatggtgtgttgtttaatgataaaagcctaaaagctgcccgttcacgtttagtgggcaaagtgttacgtattgaattacgtgaaataaatttcccattgctgttcgtgtttagtgagcgtcaagtcgatgtcttaagccagtgggatgatgctgcggactgcctagttaaaacggatgtcgctgtactggcaagattacgtgaccgccagcaactttcgcctttaatgcgcacgggtgaattggtggttgaaggtgacattcaagtagtccagcaacttgtcgcgttattagatcttgctgagtgggatcttgcggaatggttggcaccttatgtgggtgatgttgctgctgaaagtctggggcaagctattcacaaaagtagcggttttcttagtaggcaattacggcaacagcagcattatttggctgaagctatcaccgaggagtggcgaatggctcccaacctgctggaagtcatgtggtttcatgaagaagtcgatgcaaccgctcgtgcaaccgaagctttgagttccagattggcaactatggagacaaaataatgacgccaggagaacttcggcgcctgtatttaattattcgggtcttcttgagttatgggttggatgaattaattccgaatatacgtctgacgctaccactacgggttgggcgtcatctgtttttttggttatctaaccggcataaagataagtcattaggtgagcgtttacgtcttgctttgcaggagttgggacctgtctggatcaaattcggccaaatgatgtccacgcgccgcgacttgtttcctccaaatattgccgatcaattagctctgttacaagatcgggtcgcttcttttgatggtgcgctagcgcgtaagcatattgagattgcgatggggggggcgttagaaacatggtttgatgattttgattcgcaagcgctagcttcagcctctattgcccaagtacatactgcacgcttaaaagagaatggtaaggaagtcgtacttaaggttattcgccctgatatcctgccgattattaaagctgatgtacgtttaatgtatcgtttagctggctgggtaccaaagcttttacctgatggtcgcagattacgcccgcgtgaagttgttcgtgaatatgaaaaaacgctgcttgatgaactgaatcttctgcgtgaagcagcgaatgccattcaactgcgtcgtaattttgaagacagtccaatgctctacattcccgaggtgtactcggactattgtcgtgaaagcgtattagtcatggagcggatttacggtatcccggtatctgatattgctgctttagaagaccaaggtaccaatatgaagttactggcagagcgcggggtgcaagtctttttcacccaggttttccgtgacagcttcttccacgcagatatgcatccggggaatatttttgtcagctatgaacatcctcatgacccgctttatattggtattgattgcggtattgttggctcactgaataaagccgataaacgttatctggctgagaactttattgctttctttaaccgcgattaccgccgggttgctgagctacatgtggactctggctgggtacctcgagataccaatgtcgaagattttgaattcgccatccgtaccgtttgtgaacctatctttgaaaaaccactggcagaaatatcatttgggcatgtgttgctgaatctcttcaacaccgcgcgccgttttaatatggaagtacagccacagttagttctattacagaaaaccttgttatacgttgaagggctagggcgtcagctttatcctcagcttgatctctggactaccgctaagccgtttctggaaagttggctgcgggaccaggtcggtctacctgccgtaattcgtgcattaaaagagaaagcccctttctgggctgaaaaattccctgagctaccagaactggtttacgacagcttacagcagcataaattattacaacaaagtgtggagaagctcactatacagatacaaggtcagcaacaacgtcaggggcagtcacggtatttgttcggtgttggcgctacactattagtgagcggtactatcttattcttggccgatgcaaccgaagtctctacagggttcatcgttgccggtgcattggcttggtttatcggttggcgacgtacctgctaaattatttatcgcgaagaatgttgggttatgggttattgcataaccgtgagttatataaacttgttcaataagctatgaactagttcaaaatgcggtaagttagatcagtatccacagaggctgtataacgtataatacgattctctgtggaataacccctataaatagaggtaggtaatatgggcagtatcggttgggcacaattattgattatagcggtgatcgtcgttttgctgtttggtacaaacaaactgcggacgttagggtcagatttgggggcatctatcaaaggctttaaaaaagcgatgggagatgattcgcaaaccccaccaacaaacgttgataagaccagcaatgatgctgactttgcgaaatcgattacagaaaagcagcagcccgtagcaaaagctgaagaatctaagagtcacgaaaaagaacagggataagctgtgttcgatatcgggtttagtgaactgctactggtccttgtaattggtctggtcgtacttgggccggagcgattacctgtcgccgtaagaactgtttctggctggattcgtacattgcgttcgcttgcggccactgtacaaaacgaactggcacaagagctaaaactacaagagttacaagacagcctgaaaaaagtagagcaggccggcttacaaaatctgacgcctgaattgaaggcgtcgatggatgaactcaaagaggccgcagaggcgctaaaacgttcttatcatgttgatgctggatcagaagctccacatacgatccataacccattggtgacagagccggaagcgatccacgacggtgttacgccagcggagccagcaacacaggtttccgcattggcacaggcccctaatatacttgaggcagggacagcgtcagtggctgactctgtagtcgaagctgcacctgttactaccgtgaaatcggtggttcagggggaggtattggttaagtcgactccagtacaagaagtagggttggcagatgttatggataaacccgtaaccaagcagcaaatcgatacaatcgattcccatggcacggatttatccagtgctggcccatctcgtattcaccaacctggcggcgatcagtaaacatggctgttgatgatacccaaccccttatctctcatctgatagaactgcgtaagcggttactgaattgtataatcaccattttggtggtttttctggtattggtcttttttgctaatgatatctataacttggtatcagcgccgttgatcaaacagctgcctgccggtgccagtatgattgcaacggatgtggcatcaccgtttttcacccccatcaagctgaccatgatggtttcggtgtttgtttccgcaccgatgattctttatcaggtttgggcatttatcgctcctgcattatataagcatgaacgccgtttgatggtgccgttattgatatccagtagccttttattctatcttgggatggcattcgcatactttgtcgttttcccattggcttttggcttttttgccaaaacagcgccagaaagcgtactgatagcgacagatatcaccaaatacctcgattttgtcatggcgctctttatggcctttggtatttctttcgaagttccgatcgcgatcattctcttgtgttgggcgggtgtaacaacaccagaagcattgaagaaaaagcggccttatgtgtttgtcggcgcttttgttgtggggatgctcctgacacctccagatgtgctgtcccaaacactgctggctattccgatgtatctgttatttgaagttggtgtgttctttgcccgtttttataccggtaaacagcgccgtgcagctactgaagaagatgaaggtatagatagccatccgaaagcaccttaaatcgatgtgttgatatttagccgcccttctgggcggtttctgttttggaacacttatgtttgatattggtgttaatttaaccagcgtacagtttgcaaaagattatcatcaggtagtcaaccgggcaaaagaggctggggttctcggtatcctgattaccggtactgatgcagatgaaagcttggcagcacagactttggccgctgaataccctggctattgttggtcgactacaggcgttcatcctcaccatgcgagcagttggcaagatagtgtcgagcagaaaattcgaaccttggcagccactgcctccgtcgtcgctattggtgagtgcgggttagactttaaccgtaacttttccaccccagcgcaacaagaagtcgcatttaccgctcaattagctctggctgccgaactttcgctgccggtatttttgcattgtcgtgatgcccatgagcgttttattgatttgctggttccttggctagataaaataccggcggctgttgtgcattgtttcacgggtaacagtggtgagttagatgcctgtttagcattgggtttatctataggtatcacgggttgggtttgcgatgagcgtcgtggccttgatcttagagctttgctcccgcgtattcctgttcagcagctattgttggaaactgatgctccctatttattgccaagggatttgaatcctaaacctgcatcacgtcgcaatgaaccctgttttctgccccatatcgtccagcaggttgcagcctggcgacaagaagaccctaattggctaggacagaaaactgatgaaaacgcccgccgggttttccggctggtttgagttaggagaacaatatgagctatgcatttccgggcacctttcctggtcgccgtatgcgccgtgtacgctgtcatgatttcagccgccgtttggttgccgagaatcacttgacggttaatgacttgatttacccggtgtttgtcatggaagggactcaccagcaacaagccgtttcttcaatgccgggggtctctcgtatgacaattgatctgctgctgaaagaagcagaagcaattgctaagctcggtgtgccggttatatcgctattcccggtcattgaagcagggaaaaaatcattatatgcagaagaggcatataacccggatggtttagttcagcgtactgtgcgtgcgttgaaagatgcagttcctgagctaggtattctgactgacgtggcactcgatccctatacgacccatggtcaagatggtgtgattgattctgatggttacgtgatcaatgatgtcaccaaagagattctagtgcgtcaggcactatcgcatgctgaagctggcgctgagattattgcaccaagcgatatgatggatggccgtataggtgcaattcgtgatcaattagagcgccaagggttagtgaacacccagataatggcttattcggctaagtatgcgtcttgctactatggcccattccgcgatgcaattggctcgagcagtaatctaaaagggggggataaaaaaacttatcagatggatcccgccaacagtgatgaagcactgcaagaaatagctcaagatttacaagaaggcgctgatatggtgatggtaaaaccaggaatgccatatctggatgttgtacgcagggtgaaagatacttttggtgttccaacctttgcctatcaggtgtctggtgaatatgccatgcatatggcagcgattcagaatggctggctccaagagaaaccgacggtgatggagtcgttgttatgctttaagcgtgcaggtgcggatggcgtattaacttatttcgcaaagcaagttgcgcaatggctacatgatgaccagatgcagcgctaaaggatcataactaagagtcacagcattcagataggcactaactgcgcctatctgaatgaattctataatgatgaggtaatactcatccagattattgtaagtcagcgtgttattgcttttcgaactgacgattgtccaggctatgcttaatttggctattgagcatattcagtaacaacatcgagcgggcttcaccatctggttcggtataaatagcctgtaatccggcaaaaacgccatcaataatttttacgatatcaccaggtttcggtacttcaggggcaattatcttatccacagcatgggcttgcatatcagcaatgacggttgctgggatcaccgcgggctgtgtaccaaaacgaacaaaatggctgaccccccgggtggcgctgacggttgtggtatggatattttccgggtcaaactcagcgaataaataattggggaatagagcctctattacctcaatacgtttccctcgaactatcttttcgatagccactattggtgtccaacagtttacagtttgccgttccaaatgctctttggcacgtaaaatctgaccgcgtttacaatacaataaataccaagatttcatagtttcacatacctttgggtactatttagcagcataacaaaagcagtgagcgagatatagtgaggaaaaatggatcacttccaatatacagattattttgagcggtacggattgtacctatgctgatgagaattagcgataaataataacatgacgttattttaaggtgagtttgtattcatttttaacaaaaagacagcaaccactataaagacagcttataatggcgcatcccatagccgccgaaatgatcagcatgaaataccgtgacttacgtgacttcctctcattactggaacagaggggggaacttaaacgcattagccagcccattgatccttatttggaaatgacagaaattgccgatcgcacgttacgtgctggtgggcctgcgttactttttgagaaccctaaaggttacagcatgcccgtgttgtgtaatctgtttggcaccgctaagcgagtcgccatggggatggggcaagaagatgtcagcgccctgcgagatgttggtaaattattggccttcctgaaagaacccgatcccccaaaaggtttccgtgacttatttgataagctgccaaaatttaagcaggtattgaatatgccaacgaaacgcttgaactcggccccgtgtcaggagcaagtttggcaaggtgaggatgttgatttaagtcgcatccctgtgatgcactgctggccagaagatgccgcaccactagtctcttgggggttgactattacacgtggtccccacaaagaacggcagaatctaggcatctatcgccagcaggtattgggtaaaaacaaattaattatgcgttggctatcgcatcgtggtggtgcgctggattatcaggagtggtgtgaggcacaccctggtgaacgttttccggtcgctgtcgccttgggagcagaccctgctacgatcttagccgcagtgaccccggtaccagacacgctgtctgaatatgcctttgccggcttgttacgcggccataaaacggaagtggtgaagtgtctttccaatgaccttgaagttcctgcaagtgcagaaattgtattggaaggatatatcgaacaaggtgatatggctccggaaggtccttatggtgatcatacgggctattacaatgaaatagataatttccccgtgtttaccgtcacgcatattacacagcgccaagacgcaatttatcattcaacctatacgggccgaccaccggatgaacctgcggtaatgggggtggcactgaacgaagtctttgtacctattttgcaaaagcaattcccggaaattgttgatttctacttgccaccagaagggtgctcataccggttggcggtggtaaccatcaagaaacaatatgcaggccatgccaaacgcgtgatgatgggagtatggtcgtttttacgccagtttatgtataccaagtttgttattgtttgtgatgacgatattaatgctcgtgattggaatgatgtaatttgggcgatcaccacccggatggacccatcccgcgatacggtgttaattgaaaatacaccgatagattatttggatttcgcctcaccggtttccggtttgggatcgaaaatggggctggatgccaccaacaaatggccagcagagactccgcgtgaatgggggcgtccaattaagatggacgaagacgtccgtgcccgtattgatgctctgtgggatgagctggccattttcagtgacaaagacgcgaaacgctaactagcgtcggctttgtacttggttttgcatttgatgacccgacagagggaaggcatgacaactttaagctgtaaagtaacctccgtagaggccattaccgatacggtgtaccgggtgcaattggtacctgaatcttctttttctttccgcgccgggcagtatttgatggtagtgatggatgagcgtgataagcgcccattctcgatggcttccacaccgtttcagcaggactttatcgagttacatatcggtgcttcggagctgaatttgtacgcaatggcagtgatggatcgcatcctaaaagagaaaaaactggatgttgatattcctcatggagatgcctggttccgtgaagggagcaagcgtccgttggttcttattgctggcggtactggcttctcttatgcgcgatccatcttgttagccgcgttagcggaacaacctgatcgcgaagtctctatctattggggcgggcgcgaagcggtacacctgtatgatttaggtgagttggaagcactatcgattaagtatccgcaactgaaagtcattcccgtagtagaacaaccggaagagggttggcgtgggcgcacagggactgtactgagtgctgtactacaagattacggttctttagctgagcaggatatttacatcgcggggcgttttgaaatggctaaaatcgcccgtgagcgtttttgtgtggagcgtggcgcacaggaagaacatatctttggtgatgcttttgcctttatctaaaagcgataaaaagcccgcctctgaccggcggggaaatagcaactaaacacgatatacctcagttatcagggcctacgttcaggcccctaatttcttgatgtcgggtggttgtctatgtttgatggttatgtgtatttgatggttatatgtatttggctactataagcgctcaaatacggtagcaataccttgccctaggccgatacacatggttgctagcccaaattgtacgtcacggcgctccatcaggtttaacaatgtggtagagatccgtgcgcctgaacagcctaacgggtgacctaatgcaatggctccaccgttcaggtttactttatcgtccatgctttctaacaagcctaaacctttcagacaagccagtgactgagcagcaaacgcctcgtttaactcaaataaaccaatatctgccaattcaaggccagcacgttttaatgccaattgactagcaggtaccgggccatagcccatgattgaggggtcacaacctacgaccgccatcgaacggatacgtgctcgtggggttaaacctaatgacttcgctctggattcgctcataatcagcatcgcagaagccccatcggacaaggctgatgatgtccctgcagtaactgtgccatttaccggatcaaatgcagggcgcaaggctgctagaccggatagatttgtttcaggacgaatgacttcatcgaaatcaaagcgttttaatacaccttctgcatcatgcccattggttgcaacgatttcttttgcgaaatgccctgcctgagtcgcagcataagcacgttgatgagaacggaatgcaaactcatcttgtgactggcggctgatattgtgaattttagccaacatctcagcggtcaagcccatcattccagccgctttggcaacagtgcgacccattcctggatggaaatccacgccgtggttcattggcacgtggcccatatgttccactccaccaatcaaactgatcttcgcatcacccaccataatggctcgtgcgccatcatgcagagcttgcattgatgagccacacaggcgattaacggtaacagcgggtacgctgtgaggaatttcggctaataaagacgcgttacgggcaatattgaaaccctgctccaacgtttgttgcacacaaccccaataaatatcgtcgatttcagcagcattcaacccaggattacggctgataacggcacgcattaaatgggcagagaggtcttcagcccgtacatgacgaaaagccccccctttggagcggcccatcggtgtacgcacggcatcaataatgactacattttccatattttaagacctcatgctggttgattggtagaaacatcaagcagcgctgctgccacaggataataactttcgttatgttcagctttagctcgtagccccgcaggaacgtgatataacgcaccaaggtgggcatagcgttgagccatttcgacataatttgcgctaccgagcgtatcaaggtaacggaagactcctccgtggaatggagggaagccaaggccataaaccagcgccatgtcaccctcggctgcgctggcaataataccttcttccaggcagcggacgacttcattgatcattgggatcatggtgcgggcaataatgtcttcatcgctgaattcttggagaggttggctgatttctgccagtaatttatccacttgttcgtcattttctttacgtggcttaccctttgcatcttgcgtatagcggtaaaacccctgaccattcttttgcccaaatcgttggttatcaaacatcacatcaaccgcatcacggtaatccttgttcattcgctcagggaaaccggcagccatcaccgcttgtgcatgatgggcagtatcaataccgacgacatctaatagataagcgggccccatcggccagccaaactgtttttccatcactttatcaatttggtggaaatccccaccgtctctgactaacatgccaaagcctgcgagatacgggaataagacgcggttaacgaagaaaccagggcaatcattgacaacaattggggttttccccatttgtgtagcgtaagcgactactgccgcaagggttttatctgaggtttttgccccacgaataatttcaaccagtggcatctggtgtactggattgaagaagtgcataccgcagaaattttcagggcgtttgagtgatttagccaactgatcaataggaatcgtcgaggtattggaagctaaaacggtatcttcaccgattaatgcttctacttccgcaagtacagcggctttaaccttcgggttctccaccacagcttcgacgatcacttgggctcgttcaatacctgcataatccaaggttggtcgaatagtcgccagaatacttgccattttaaggccatccactttgccgcgttccagctgtttattcagtaatttagcggcctcattcattccaagatccagcgagttttcattaatatctttcataatgactggcacacttttcagcgctgactgataggcaattccacctcccatgatccctgcgcccagaaccgcagccagttttggtgcagcgacgcctttggacagttttttggcttgcgcttttacatactggtcgttaagaaaaatccccaccaaagcgcgagcttcattggaacccgctaaagggacaaaactgttggtttccaagttcagcgcttcggtacgaccaaattttgcggcggcttcaatagtttttactgcagtcaatggtgcgggatagtgtttcccggcgacttgcatgactctgcctttagcaatggtaaaacacatagccgcttcggtaggattaagttttaggggttccagttttgggcggcgtgctgcctgccaatcgagcttaccgtcaatagcttgtttcagcatagttaaggctgaaccgaccagtttctcagggtcgacaactgcatcaaccagcccaatctttagtgcatcgttggcagtaacatctttacctgtggcaataatctcaagtgcactatcagcgcctagcaggcgtggcaaacggaccgaaccaccgaagcccggcatgatgcccaacttggtttctgggaggccgatacgtgcttctggggaggcgatacggaaatccgtcgccaaaatacattcacatcctccacctagtgcgtatccattaattgctgaaatggttggcacgggtaaatcttccagtcgattgaaaatggtgttggcgaacaccagccactggtgcagtttttctggtggggcattaaacagggatagaaactcagtaatatcggcaccaacaatcaaggctgtcttcgctgaacgtaatagcaaccctttgagttcactttgtttttctaacacattcaaggcttcacccaaattggctacggttttagtatccagtttattaactgaacccggagcatcaaataccaactcggcaataccgttttccaaccagtgaagctgtaatgtttcgctttggtagagcatatctatctcctgaataagcgcatgtgatctggtatgaccagatattcaggaagtgtggttattttgttaatgaaatgcaaatgagagattgtttttttgcagtgaagatcacaatcaataaggtagactaattgatctttatcatatttattcgagatgtttcgagagactaaataatcgttctattacgcgggcagagtttggctgcaacacccattattttgggtatagtggctatcaatttgtagaataaacgtcatcgaaacatggtttcggtgactatgataagataaaaaaattaagttctaatagcgaagggtactgtgatggaaacgctggcttctttatataacgaacatttatccactctacaacagcgcacccgcgatgtgctggagcgtcatcaattagatgcgttgctgattcactctggtgaattacagcggctttttcttgatgaccgtgactatccctttaaggttaatccacagtttaaagcttgggtccctgtgactgaggtccccaattgctggttatgggttgatggagtcaatacaccaaaattatggttctactcaccggtagattactggcacagtgtcgaaccgctacctgatagcttctggacgaagaatattgatgttcagccattgctgaatgctgatgatattgcgcaacaattacctgttcagcgtgaacgtgttgcttatattggttatgcccagcagcgtgcacaagctttaggcttcagtgctgagaacattaacccgcagccggtcttggattatcttcattattatcgctcttataaaacggattacgaactggcgtgcatgcgtgaagcacaaaaaactgcagtcgtagggcatcgtgcggcctatgaagcattccagtcgggtatgagtgagtttgatattaatctggcttacctgatggctaccggacatcgtgatactgatgttccttacgataatattgtcgcgctgaatgaacactccgcagtacttcattatacgattttacagcatcaacctccggcagagatacgtagtttcctgattgatgccggagctgaatataatggctatgctgccgatctgactcgtacttacgcagcagaccgtgacagtgattttgcggctttaattagcgaccttaatactgagcaattggcgctgatcgatacgattaaaagtggtgaacgctatactgattatcacgttcagatgcatcaacgcattgctaagcttttgcgtacacataatttagtcacggggatcagcgaagaggcgatggtcgaacagggaattacctgcccattcctgccacatggtttgggtcatccacttggtttgcaagtgcatgatactgctggttttatgcaggacgataaaggtacgaacctgaacgcgccatctaagtatccttatctacgttgcacacgtgttctgcaaccgcgcatggtgctgactattgagccgggcctgtactttatcgattctttgttggctccttggcgcattggtgagttcagcaaacattttaattgggatcgtattgatgcactgaagccttatggtggtattcgtatagaagacaatattgttattcatgataaacgggtcgaaaatatgacgcgtgatctgaaactggcctgatgcagccttatctgatacccgctatgccggttactatcagcgaagagatcaagaaaagccgtttcattaccttattggctcatacctgtggggttaatgaggctaaagattttattcagcaggttaagcaacaacatccaacggcccggcatcattgctgggcttttgttgccggtcccccgacggattctcagcagttaggtttttccgatgatggagaaccctctggcaccgccggtaaacccatcttggcacaactgatggggagtgatattggagaaattacggctgttgttgtgcgttattatgggggcattaaacttggcacaggtgggttagtaaaagcttatggtagtggtgtgcagcaggcactaaaacaggtagcggtaaaatataaagtcccacaggtggaatatactttacagtgtgactatgcgcagcttgctatggtagaaatgctattacagcaggttgaaggccagattttacgaggtgaatacacggaacttgtaacacttcatctcactctgccagcaactcaagccagccaagtcggggataaattgcgtgatctcagtcgtggtacattgcaattaacacctatttcgtaataatccccatccaagtgaattgctaaggaacgtgccggaatgcattttcgtgccataacccgtattgttggtctgctggtcatcttattctccggaacaatgtttattcccgggctggtggctttgatctatcgtgatggtgctggccgtgccttcagtgaaacgttttttgttgctgtgtctatcgggcttttgctttggttaccgaatagaaagcagaagcatgagttaaaacctcgcgagggttttctcatcgtcgtattattttggacggtgttgggtagtgtcggggcattaccttttttattctcagagcggcctaatctttcattaactgatgcattctttgaatcattctcagggttaactaccacaggggcaactaccttagtggggttggattcacttcccaaagcaattctattctatcgacaaatgctgcaatggcttggtgggatggggatcatcgtactcgctgtggctattttgccaattttgggcgtcggggggatgcagctctatcgtgcagaaatgcctggtccgctgaaagataataaaatgcggccccgcattgctgaaacggctaaaacgctctggctcatctatgtactactgactatcgcttgtgcgcttgccctttggggagcagggatgtcggtatttgatgctatttctcatagtttttcgacaatagctatcggtggtttttcaacccatgatgccagcattgggtactttaacagcccaacgatcaacacaattattggcatattcttgctgatttctggctgtaattttggtttacactttgcggtactcagtggcagaagcttgaaagtctattggcgtgatcccgaattccgtatgtttatctttgtacaattgacgctagttatcgtttgtaccttagtgctctggcaacatagtgtatataagtccggaatagaaaccttaaatcaggcgttcttccaagtggtttcaatggctactacggcgggcttcacgaccgacagcattgcgaaatggccgctcttcttgcccctactcttattatgttctgcttttattggtggttgtgcggggtctaccgggggcggcctaaaagttattcgtatcctattactctacttacaaggttcacgcgagttaaaacggttggtccaccctaatgcggtttacaccattaaactggggcggcgtgcattacccgagcggattcttgaagcggtttggggctttttctctgcttatgcgctggtcttcattatcagtatgttagcgatcgtcgcgactggggttgatgaattttctgccttcgctgctgtcactgcgacgttgaataacctcgggcccggtttgggggtagtggctgataactttacatctatgaatcccgcagccaaatggatattggtgattacgatgttatttggccggctggaagtcttcactttgctagtccttttcaccccaacattttggcgcgagtagttctgcataaggaacattactatgaaaatactaatactttactccagccgagacggccaaacgaaaactatagcttcttatatagctaagcaattaacagaggcagccacttgtgaaatacaagacctatctcaagtaggccaaatcgatctgagccagtatcagcaagttatcattggggcttctgtacggtatggacatttcagccccgtgttgaataagttcgttaataaacacgttgcgcaattgagtcagatgccaagtgcattctttgctgtgaacttaacggcacgcaagccagaaaaacgttcgccacaaaccaatacatatgtacgtaagtttttattgaacactccctggcagccaacgttgtgctcggtattcgctggtgctctgcgttatccacgctacagttggatagatcggataatgattcaacttattatgcgtatgactgggggagaaaccgataccagtaaagaagttgagtatacggattggcaagaggtaagccgttttactcaggatttcttggcactgcagtataaaaagtagctatcacgctggttatcacagcaaattgctgaaaaaaaacacggttgaaaagttttttgaaattaggggttgcaggctgtcaggaactccctataatgcgcctccactgaccgggaacaacgaaacacacttcgccgggtcaggaagagaaaagcagacttgaacttcgaaagaaataaaagaaaaccttgactcttcagcgggaaagcgtattatctgcctcccgcgttaccgtaagattcgccgcaaggcaaacgggtaacgaacgctctttaacaatttatcagacaatctgtgtgggcactcgcaagacgatatcgacgcctgtttcggcaggcagaaataatatcaagtcttgaagagtgaccaaagcagtaaacattttgactccggtcagaatgcatatttgcagaaagtaatctttgagcaccgctgcttttacgcaagtaaaagtcagcaaatcaaacaaatcttaaattgaagagtttgatcatggctcagattgaacgctggcggcaggcctaacacatgcaagtcgagcggcagcgggaagtagtttactactttgccggcgagcggcggacgggtgagtaatgtctggggatctgcctgatggagggggataactactggaaacggtggctaataccgcatgacctcgcaagagcaaagtgggggaccttagggcctcacgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggttgagtttaatacgctcaatcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtgggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaatttggcagagatgctaaagtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagtcagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaacgatacgcattgcgcagtgcccacacagattgtctgatagaaagtaacgagcaaataaagccgggctgagaaattggtcgggctttagtaccttgttgggtctgtagctcaggtggttagagcgcacccctgataagggtgaggtcggtggttcaagtccactcagacccaccaactcaccattccctgttgagttgcagcaataaggtgatttgctttttatatggggctatagctcagctgggagagcgcctgccttgcacgcaggaggtcagcggttcgatcccgcttagctccaccatataaaactatttcaaaacgtactgcggtcgcaaggcacagtgtgttgtgaaatattgctctttaacaatctggaacaagctgaaaattgaaacattacagctgaaatttaccccgccgtagatgtattggggtaaagagtaacctgtaatagagtctctcaaataatcgcaacacaagatgtactgtcagcaatgataagacaccttcgggttgtgaggttaagcgactaagcgtacacggtggatgcctaggcagtcagaggcgatgaagggcgtgctaatctgcgaaaagcgtcggtaagctgatatgaagcgttataaccgacgatacccgaatggggaaacccagtgcaatacgttgcactatcgttagatgaatacatagtctaacgaggcgaaccgggggaactgaaacatctaagtaccccgaggaaaagaaatcaaccgagattcccccagtagcggcgagcgaacggggaggagcccagagtctgaatcagtttgtgtgttagtggaagcgtctggaaagtcgcacggtacagggtgatagtcccgtacaccaaaatgcacaggctgtgaactcgatgagtagggcgggacacgtgacatcctgtctgaatatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagcaccttcgtggtgtgactgcgtaccttttgtataatgggtcagcgacttatattttgtagcaaggttaaccgaataggggagccgtagggaaaccgagtcttaactgggcgtctagttgcaaggtatagacccgaaacccgggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatcttcgggggtagagcactgtttcggctagggggccatcccggcttaccaaaccgatgcaaactccgaataccgaagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacacttaggtgttgttgggtaggggagcgttctgtaagccgttgaaggtgacctgtgagggttgctggaggtatcagaagtgcgaatgctgacataagtaacgataatgcgggtgaaaaacccgcacgccggaagaccaagggttcctgtccaacgttaatcggggcagggtgagtcgacccctaaggcgaggctgaaaagcgtagtcgatgggaaacaggttaatattcctgtacttggtgttactgcgaaggggggacggagaaggctaggctggccgggcgacggttgtcccggtttaagcgtgtagggggagtgaccaggtaaatccggttgcttatcaaccctgaggcgtgatgacgatgcactacggtgcagaagcagttgatgccatgcttccaggaaaagcctctaagcatcaggtaacattaaatcgtaccccaaaccgacacaggtggtcaggtagagaatactcaggcgcttgagagaactcgggtgaaggaactaggcaaaatggtgccgtaacttcgggagaaggcacgctggcgttaggtgaaaggactagctcctggagctgaagccagtcgcagataccagctggctgcaactgtttaataaaaacacagcactgtgcaaacacgaaagtggacgtatacggtgtgacgcctgcccggtgctggaaggttaattgatggggtcagccgcaaggcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggccttgaagtgtggacgccagtctgcatggagccaaccttgaaataccaccctttaatgtttgatgttctaactcggccccataatctggggtgaggacagtgtctggtgggtagtttgactggggcggtctcctcccaaagagtaacggaggagcacgaaggttagctaatcacggtcggacatcgtgaggttagtgcaaaggcataagctagcttgactgcgagagtgacggctcgagcaggtacgaaagtaggtcttagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggaagattgagaggggctgctcctagtacgagaggaccggagtggacgaatcactggtgttcgggttgtcatgccaatggcattgcccggtagctaaattcggaagagataaccgctgaaagcatctaagcgggaaacttgcctcgagatgagtcttccctggggcttaaagccccctgaaggaacgttaaagactatgacgttgataggctgggtgtgtaagtgcagcgatgtattgagctaaccagtactaatgatccgtgaggcttaaccttacaacaccgaaggtgttttgaattgagagagattttcagcgtcgttccgagattggattgactggcgtcacaagcgttgtttgtgtgcgggttaattaaaacagaatttgcctggcggccatagcgcggtggtcccacctgatcccatgccgaattcagaagtgaaacgccgtagcgccgatggtagtgtggggtctccccatgcgagagtaggacactgccaggcatcaaataaagccaagaccccatgcccaaagcgtggggtttttgctgtgcgcgaaacacagaaattgcgcgttgtagcgagtagaatttcgggtttatgaaccatagactgacaaggtctattagtgtgaaatatgacacttatagaaaaaatctgcccgatatcaaatcctcctagaattctagggccaatttcctttgtactggtaccagtactcacagtgacgaccagattaaagcaggtttaccaagcgttctcccactctttaaataacattccatttaccctagccttaggtagtatcaagacttcttagccctatccgatgaaatttttctggtgatgatatcgctagtagctcgatcactactttttcattatttacttgaaataaaaaatacaaacagcccattacgatcggttagactagcgcgagagttatttagaatgagcatctaatgtaatgtcgaatcagcgttcctctctaaaacaccttaatacctttgcgctacctgcttatgcaagcaatgtcattagtgctggctcagtagaaacattaattgcggcttggcatgaatcaaaagccaagcgacagccggtactattactaggtgaaggtagcaatgtgttatttattaaaaatttctctgggacagtattactcaataggattatggggattacttctaccgaagacagtgctgcttggcatttacatgtcggtgctggggaaaattggcatcaactggtatgtcattcactgcaaaataatatgccggggttggaaaatttagcgttaattccaggctgtgtcggctctgcgccgatccaaaatataggtgcctatggcgttgaattaaaacaagtatgtgaatatgttgatttacttgatatggataaaggtactattcagcgtatctccgctgaggagtgtcagtttggttaccgtgacagcatttttaaacatcgctatgggaatggatttgctatcgtatctgtcggtattaaattgatgaaatcatggactccaacgctgggttatggcgacttaatacatatggacccattaacagttactgccacagatatttttaactctgtctgtacaatgcggcggagtaaacttccagacccaatggtcactggcaatgccgggagtttcttcaaaaaccctgtagtaagcgcagcaatcgctgaggagatcgtacattgttaccccaatgctcctcattatctgcagccagatgggtcagtaaaacttgcagcaggttggttgatcgatcagtgttcacttaaggggtaccagattggtggtgccgcagtacaccagcaacaagctctggtgctgattaaccagtcagaagcgactggccaagatgtaatacatcttgcacgttatatccgccagcaggtcgcacagagattttcaatctggctagaaccagaggtacgctttattgctgataatggtgaagttaatgctgtggagcatttatcgtgaaagatatcagggtccccttacggttagtcagtatattatctgatggtttttttcactccggtgagcaattgggtgaaacgttaggcatgagtcgcgctgcgattaataaacacatgcaaactattagagattggggtttagatgtttttactgtcccaggtaagggctacagcttacctacttctatccaattgcttgatgaacaaaaaatattaagttatttacctacgggtcacgtaacagtattacccgtagtcgattctactaatcaatatttattggatcgtattactgaattgaaatcaggtgatgcgtgtgttgcggaatatcagcaagcaggacgaggtcggcgtgggcgtcaatgggtttctccttttggtgctaatctttatttatcaatgtattggcggctagagcaaggtcctgctgctgcaatgggattaagcttggttgttgggattgttatggcagaggttctgcagaatttaggtgcagagaaggttcgtgttaagtggcctaatgatctgtatttaaatgataaaaagctggccggaatattagtagagcttactgggaaaacgggtgatgctgcacaattagtcattggtgcaggtattaacctgacaatgcgtggttcagaaacaaatgctattaaccaagattggataaatttgcaggatgctggtgttactatcgatcgtaataaactcactgctgagatcttatctgaattacggcttgcagtagttaagttcgaaaatgatggcttatcggcattcctttctcgttggcagaaaatggataattatcttaataggccagtgaaattaattattggtaatcaagagatttttggtattgctcgcggaatcgatcagcaaggcgcattattattagaacaagatggcaatataaagccttatattggcggtgagatatcccttcgaggtgtctgattaattaatgggagataactatctcccgtatagattattttcttaagcgtacactttctactgcatgattggcacttttcgtcattattaaacttgctctttcacgagttggtaaaatattttgctttaaattcaatccattgatctcattccataattgagtggcgatcttaatagcctctgtctctggtagttttgcataattatgaaagtaagagtctggatttgagaatgcaccctgacgaaatttaagaaatctattaatataccaactctgaagtaaatcctcaggtgcatccacatatatagagaaatctacaaagtctgatacaaatacgtgatggggatcatgtgggtagtccatcccgctctgtagcacatttaagccttctaatattaggatgtcgggttgcttgattaccttattaccgtcagggacaacatcatatattaaatgagaataaacgggtgcagtaacataatccgctcctgatttaacctcagagacaaatttcactagattatgcatatcataggattccgggaatccttttttcttcattagcccacgttcgttgagcaccttattaggatgaaggaaaccatcggttgtaatgagttctacgctacgatgttccggccaacggctaagcaaagcttgcaataaacgggcggtagtacttttaccgacagctacgctgccagcaatgccgatgacataaggaatacgttggccatcagtcccaaggaattgctcaagaacagcctgacgacgcaaattagagctaatataaaaattaagtaggcgtgaaagtggaaggtaaatttgtgccacttcatctaatgaaaggtcttcgttaatccctttgagtttaacgatttcttcttctgtcagtgtcaatggcactgagtcgcgtaatgccgcccattgggtacgatcgaactgtagataaggcgtcgctaaagattgttctctttttgtcataagccaaattctgcctgttaacgcaggttgggaaaggcgctggacgccaactccagataagaaacaagctgcatattataggcagcttggtttttggtgtagacatttttgcgcttagtgagtgatttctttgacgcgtgttgctattccaatcaattaagagggcttatggcaggttcaggtattttctattttttacactatggttcattagttttgtatggccgtgtgtggttgaaccacggtaaacaagcgtttgaaataaattgcggttggatgatagttaccattaggagtgcaggcatagtcagggatctcccccacataacggtagccctgtgcccgataaaaagactcagcggaagaacccgattgagtatctagatatattaatccacggcgtaattgtactgcggtgttttctgcagcaatgattaatttatgtcctatcccagtgcgacggctacggctatgaacaagtaatttttgtatttcagcccgatttaagccattcggtttttggcaaagaactaattggatagtaccgatgatgccaatttcatcacgtgctatccataagagtaatgcttctctctctatggctgggtgtagactgtggaaataaccctcagcttcttcctgggaaagtgtatgcgtattgtaacccacggaggcaccataagtgaccgcatcaataagtaaactggctaacccacttcggtatatggggaaagttgcggcattaagcaaaactatcttcataataaaatttctctctgaaactgtctgctctgatatccattgctaagcaataaacaagccaaacttataaagtgggcagtagtaagcgcttttctgcttattagccattcaggaatgcactgatgtagaataattttccccattgtggtgcatatgactaaagtgatattcaggacaatattgttcggtgatgagatatggatgagatttttgaggatgaatcttataatgatagacgggtacaatatttgattttttgagtattaattgagctgattatgcttgataatacctctgcggcgtaaaaggtggtcgttttatgagcaaagacgcgagttatgcaatttttttgttgcatcatggctccgctctacctagaatgcgctgcacttgatgccggcatagctcagttggtagagcaactgacttgtaatcagtaggtcccgagttcgactcttggtgccggcaccattcaagtactaaaatttaggtggggttcccgagcggccaaagggagcagactgtaaatctgccgtcatcgacttcgaaggttcgaatccttcccccaccaccatgtttaaccttgagtcccagggtaattcagaacgttgaatccccagtaagcactcaaggcgagggtagcgtacctcgatgaagagtgaagtggccaagcccttcctttcagatttctgcagattaagtcaggtagccgagttctaagatgcgggcatcgtataatggctattacctcagccttccaagctgatgatgtgggttcgattcccactgcccgctccaagatgtgctgatatagctcagttggtagagcgcacccttggtaagggtgaggtcggcagttcgaatctgcctatcagcaccatttctcattctctcgtcccctgattttctttctgttttatggattcagcaagcatatgcttggttgatacggtgaaaccaccgattccgtgtcttagagggacaatcgatgtctaaagaaaagtttgaacgtacaaagccgcacgttaatgtgggtactattggccacgttgaccatggtaaaactaccttaactgctgcaatcaccaccgtattggctaaaacctacggcggtagtgctcgtgcattcgaccagatcgacaacgctccggaagaaaaagcgcgtggtatcaccatcaacacttctcacgttgaatatgatactcctgctcgtcactatgcacacgttgactgcccaggtcatgctgactacgttaaaaatatgatcaccggtgctgctcagatggatggagcgatcttggttgttgctgcaaccgatggccctatgccgcagactcgtgagcatatcctgctgggccgccaggttggtgtcccatacattattgtcttcctgaacaaatgtgacatggttgacgatgaagagttgctagagttggttgaaatggaggttcgtgagcttctgtctcaatacgatttcccaggcgacgacactccagtcatccgtggttcagcgttgaaagccctggaaggtgacgctgagtgggaagctaaaattatcgagttggcagaagctctggatagctatattccgcaaccagaacgcgctattgatagaccattcctattgccaattgaagacgtattctctatttctggtcgtggtactgtagttactggtcgtgtagaacgcggtattgttaaggtcggcgaagaagttgaaatcgttggtattatcgatacgattaaaacaacttgtactggcgttgaaatgttccgcaagctgctggatgaaggccgtgctggtgaaaatgttggtgttctgctgcgtggtactaagcgtgacgatgttcagcgtggtcaagtactggcgaaaccaggttctatcaagccacacacgaagtttgagtcagaagtttatattctgagcaaagatgaaggcggccgtcatacaccgttcttcaagggctaccgtcctcagttctacttccgtacaactgacgtgaccggtaccattgagctgccagaaggcgttgaaatggtcatgcctggtgacaacgtaaacatggttgttaacctaattgctcctatcgcaatggatgatggtctgcgcttcgcaattcgtgagggtggccgtactgttggtgctggcgttgttgctaaagtcattgaataagatttgacgcgacatgcgataaaagggcatcatttgatgccctttttatacgttgcatactagaacctatctcgtcagtggtttttttaatcgtaattactggtgagataggctctggaaatacggcgaatagtgctgaaatagtgctgagtggtgccgattagagagtctctagagcatccttcggcttggtttgctttgcgatgcgaagcaaagttgtttgttctgaatcatagtgacaggttggtttatgagtgcgaataccgaggctccagggagcggacgcggcctggaaacggctaaatggctaatcgttgctgtattgttagtcgtagcaattgtcggtaattattattaccgtgaatatagcttgccgctgcgcgcgttggcagttgtagtaattatcgctgttgccggtgctgttgcattgatgacagcaaaaggtaaagccactgtagcctttgctcgtgaagcacgcacggaagtgcgtaaagtgatttggcctacccgtcaggaaacactgcatacaacgttaatcgttgctgcggtcactgctgtaatgtcactgattctatggggactggatggtatcctagtccgcttggtatcatttattactggcctgaggttctaagatgtctgaagcacccaaaaagcgttggtacgtcgttcaggcgttttccggttttgaaggccgtgtagcacaatcgctacgtgagcatatcaagttacatgacatggaagagctgtttggcgaagtcatggttccaacggaagaagtcgtagagattcgtggcggtcaacgccgtaaaagtgaacgcaaattcttcccaggctatgtgctggtccagatggtcatgaatgatgccagctggcacttagtacgtagcgtgccacgtgtaatgggctttatcggtggtacatccgatcgcccggcaccaatcagtgataaagaagttgatgcgattatgaatcgtcttcagcaagtgggtgataagccacgtccgaaaacactgtttgaaccaggcgaattggttcgtgttagcgatggtccgtttgcagacttcaacggtgttgttgaagaggtggactacgagaagagccgcttgaaagtatccgtttctatttttggccgtgcgacaccggttgaattggatttcagtcaggtagaaaaaggctgattcatttttcagcggtggttgaaatttgagtcttgtcttaggcgcgaaattaaaatataatttcgcgccttttgtttttagatgttttgcttttgtcatccgtggtaaccacatccatggaaataacaagcgagacaaaacacggggagcctcaaacgaggcgatactacccaaatcgaggaaatcgtaaatggctaagaaagtacaagcctatgtcaagctgcaagtagcagctggtatggcgaacccaagcccaccagtcggtccggctctgggtcagcagggtgttaacatcatggagttctgtaaagcgttcaatgctaagactgaaagcattgaaaaaggcctgccgatcccagttgttattactgtttattctgatcgctctttcactttcgttactaaaaccccgccagcagcagttctgctgaaaaaagcggcaggtattaagtctggttctggcgtgccgaacaaagacaaagtaggtaaagtgaccagtgctcaggtccgtgaaatcgcagaaaccaaagctgcggatatgactggttctgacgttgacgcgatgatgcgttcaatcgaaggtactgctcattccatgggcctggtagtggagggttaataaatggctaagctgaccaagcgcatgcgcgtgatccgtgacaaagttgatgttactaagcaatacgatatcaacgaagctgttgctctgctgaaagagctggctactgctaaattcgtagaaagcgtggacgttgccgttaacctcggtatcgatgcacgtaaatctgaccaaaacgttcgtggcgcgactgtgttgccacatggtactggccgttcagtacgcgttgctgttttcgctcagggtgcaaatgctgaagcggcgaaagaagcaggcgctgaattggtaggtatggacgatctggctgatcagatcaagaaaggcgaaatgaacttcgacgtcgttattgcttctccagatgcaatgcgcgttgttggtcaattgggccaaatcttgggtccacgtggcctgatgcctaacccgaaagtgggtaccgttacacctaacgttgctgaagcagttaaaaatgctaaagcaggtcaggttcgttatcgtaatgataaaaacggtattatccacactaccattggtaaagttgatttcgactcagataagttgaaagagaacttagaatctctggttgttgcgctgaaaaaggctaagcctgctacagcgaaaggcatatatatcaagaaaatcagcctgtccactaccatgggtgctggcgttgctattgatcaaagcggcctgactgcagtagtgaactaatcactaattgcttttatcgctttacgtgggcgtaaggtttgtctagaatcttacgcccatgctatctgttgatcgttgtatcgccttcgacagagcaacaaaatttttcggttggagcttggccttatccaagcctccgtccaagaccgcaggtgtgttgaaaaacacttaatttcctgcgtagacggtgacagaacctaaagaaaatttttctttctttatttgtttataaagaatgataaagaatagtctttgctggattctgctcaccgtgtttcaacgctcgttcacggcaattttgtcgtgaattgggtgacgtgagttccggagaattattctccggttaatccaggagcaagaactaatggcactaaatcttcaaggcaaacaagcgattgttgctgaagttaaagaagtagccaaaggtgcgctgtctgcggttgttgcggattcccgtggcgttaccgttgataaaatgactgaactgcgtagagcaggtcgtgaagctggcgttcatatgcaagttgttcgtaacaccttgctgcgtcgcattgttgaaggcactccattcgaatgcctgaaagacacgtttgttggtccaaccttgattgcattctctgctgaacatccgggcgcagctgctcgtctgttcaaagcatttgctaaagataatgcaaaatttgaggttaaagcagcagcctttgaaggcgagttaatccctgcggctcaaatcgaccgcttggcaactctgccaacctacgaagaagcaatcgcacgtctgatgggaaccatgaaagaagctgccgctggcaagctggttcgtactctggctgcgctgcgcgatcagaaagaagctgcttaattgccttttttcttcatcgttgctttttaacgtataaactatttctgtattttaggaacacttgttatgtcaactatcactaaagaccaaattctggaaggcgttgcagctctgtctgtaatggaaatcgttgaactgatctccgctatggaagaaaaattcggcgtttcagctgctgctgttgctgcaggtcctgctgctgctgttgaagctgcagaagaacaaactgaattcgacgttgttctggcttcattcggcgagaacaaagttgcagtaatcaaagctgttcgcggcgcaactggcctgggcttgaaagaagctaaagatctggttgagtctgcaccagcagttctgaaagaaggcgtgaacaaagacgaagctgagacgctgaaaaaatctctggaagaagctggtgcttctgttgagatcaagtaagtttagctttgagttcgcagcctaactttataggctgatggctggtgactttttagtcatcagcctttttgcgctgtagggcgtcagtagcatttcacactgtttagctactgactaacccctaatattcctttctattgacgacttaatatactgcgttctcagctacgacccactcgggtagctcggtagtcaaggtaacgcgatgaaatggtttaagagtgatagaaaagagtattccgggaagtgtttcgacttctcgatcaaaataatagtgttgcatgacctgtcctagtttagggcggacagagtgggtcactgatcagcgagctgaggaaccctatggtttactcctataccgagaaaaaacgtattcgtaaggattttggtaaacgtccacaagttttggacataccttatctcctttctatccaacttgactcgttccagaaatttatcgagcaagatcccgaagggcagcacggactagaagcagcattccgttctgtttttcctatccagagctacagcggcaattcggagctgcaatacgttagctaccgtcttggtgagccagtattcgacgtcaaagagtgccagatccgtggtgtgacttattcagcaccgctgcgcgttaaactgcgtctggttatctatgagcgggaagctccggaaggtacggtcaaagacatcaaagaacaagaagtctacatgggtgaaattccactcatgaccgaaaatggtacctttgttattaacggtactgagagggttatcgtatctcagttgcaccgtagccctggtgtgttctttgacagcgataagggtaaaacccattcatcgggtaaagtgctgtacaacgcacgtatcatcccttaccgcggttcatggttagatttcgagtttgatccgaaagacaacctgtttgtacgtattgaccgtcgccgtaaattgcctgcaaccatcattctgcgtgcattgaatttcaccactgcacagatcttggatctgttctttgagaaagtggtctttgagattcgtgataacaagctgcagatggaattggttccagagcgcttgcgcggtgaaacggcatcctttgatattgaagcgaatggcaaagtttacgtcgagaaagcgcgtcgtattactgctcgtcatattcgccagcttgaaaaagacggcattgaccgcatcgaagtaccggttgaatacattgccggtaaagttgttgctaaagactatgttgatgcgagcaccggtgaactgatctgtgcagctaacatggagctgtcactggatctgctggctaagttgagccaagctggccacaagcaaattgaaacattgttcaccaacgatctggatcacggtgcttatatctccgagaccctgcgtgttgacccaaccagcgatcgtctgagcgctttggttgagatctatcgcatgatgcgtcctggcgagccaccaacacgtgaagccgctgaaaatctgtttgagaatctgttcttctccgaagaccgctatgatttatctgcggttggccggatgaagttcaaccgttctctgctgcgtgacgagatcgaaggttccggtatcctgagcaaagaagacatcacagaagtgatgaaaaagctcattgatatccgtaacggtagaggcgaagtggatgatatcgaccacttgggcaaccgtcgtattcgttccgttggcgagatggctgaaaaccagttccgtgtaggtctggttcgtgttgagcgtgcagttaaagagcgtttgtctctgggcgaccttgatactctgatgccacaggacatgatcaacgccaagcctatctcggctgcggtgaaagagttctttggttccagccagttatcccaatttatggaccaaaacaacccgttgtctgagattacgcataagcgccgtatctctgcattgggcccgggcggtttgacccgtgaacgtgctggctttgaagttcgagacgtacacccgactcactacggtcgcgtatgtccaattgaaacgccagaaggtccaaacatcggtttgatcaactccttgtctgtatatgcacagactaacgagtatggtttcctggaaacaccttatcgtcgtgtacgtgatggtgtggtgaccgatgaaattaactatctgtctgctattgaagaaggcaacttcgttatcgctcaggcgaactccaacctggatgatgaaggccgctttttagaagatttggtgacttgtcgtagcaaaggcgaatcaagcctgtttagccgcgagcaagttgactacatggacgtatctactcagcaaatcgtatccgttggtgcttctctgattccattcttggaacacgatgacgccaaccgtgccttgatgggcgcgaacatgcaacgtcaggcggttcctactctgcgtgctgataagccgttggtgggtactggtatggaacgtgcagtggcggttgactcaggggtaacctctgtagccaaacgtggcggtactgttcagtacgtagatgcatcccgtatcgttattaaagttaacgaagatgagatgcacccaggcgaagccggcattgatatttataacctgaccaaatacacccgttctaaccagaacacctgtatcaaccagatgccgtgtgtgaatctgggtgagccaatcgagcgcggtgacgtgctggcagatggcccatcgacagacctgggcgaactggcattgggtcagaacatgcgcgtagcgttcatgccttggaacggttacaacttcgaagactccatcttagtctccgagcgcgtggtgcaagaagatcgcttcacaaccatccacattcaggaattggcatgtgtgtcacgcgacaccaagttagggcctgaagagatcactgccgatatcccgaacgtgggtgaagccgcgctctccaaattggatgaatccggtatcgtgtatatcggtgctgaagtgactggtggtgacattctggttggtaaggtaacgcctaaaggtgaaacccaactgacgccagaagagaaactgttacgtgcgatcttcggtgagaaagcgtctgatgttaaagactcttctctgcgtgtaccaaacggtgtttctggtacggttatcgacgtccaggtctttactcgcgatggcgtagaaaaagacaaacgtgcgttggaaatcgaagagatgcaactgaaacaggctaagaaagacctgactgaagagttgcagatcctggaagcgggcttgtttgcacgtatccacgcggttctggtttctggtggcatcgaagctgagaagctgagcaagttaccacgtgaacgctggctggaactgggcctgaccgacgaagacaagcaaaaccaactggaacagttggcagagcagtacgacgaaatgaaatccgaattcgagaagaagatggatgccaagcgtcgtaaaatcacccaaggcgatgatctagcacctggtgtgctgaaaatcgtcaaggtgtatctggcggttaaacgtcagattcaaccgggtgataaaatggccggtcgtcacggtaacaaaggtgttatctctaagattaacccaatcgaagatatgccttacgatgaaaacggtacaccggtagacatcgttctgaacccgctgggcgtaccatcgcgtatgaacatcggtcagattttggaaacccacttagggatggcagcgaagggtatcggcgagaaaatcaacgccatgctcaagaagcaggaagaagttgccaaactgcgtgagttcatccagaaggcctacgatctgggcgacaacgtttgtcagaaagttgatctgagcacctttaccgatgacgaagtactgcgtctggcagagaacctgaaaaaaggtatgccaatcgcaacaccagtcttcgatggtgcgacagagaaagaaatcaaggaactgttacagctgggtggcctgccaacgtctggtcagattaccttgtttgacggccgtaccggtgagcaatttgaacgccaggttactgtcggctacatgtacatgctgaaactgaaccacttggttgatgacaagatgcatgcgcgttctaccggttcttatagcttggttactcagcagccgctgggtggtaaagctcagttcggtggtcagcgcttcggtgagatggaagtgtgggcgttggaggcttatggcgccgcgtacacattgcaagaaatgcttaccgtcaagtccgacgatgtaaacggccgtaccaagatgtacaaaaacatcgtggatggcgatcaccgtatggaaccaggaatgccggagtccttcaacgtattgttgaaagaaatccgctctctgggcatcaatatcgagctggaagaagagtaattcttcaccagacggcaaactctcatagccgggagtttgctggtggttcgcactggtcacaggggcactcaaacctaggttcttaggtttgagtgcctatcaggtctaactccgacaggagccaatccgtgaaagacttattaaagtttctgaaagcgcaaactaagaccgaagagtttgatgcgatcaaaattgctctggcatcgccagacatgatccgttcatggtcattcggtgaagttaaaaagccggaaaccattaactaccgtacgttcaaaccagaacgtgacggccttttctgcgcccgtatctttggcccagtaaaagattacgaatgcctgtgcggtaagtacaagcgtttaaaacaccgtggtgttatttgtgagaaatgcggcgttgaagtgactcaaactaaagtgcgccgtgagcgtatgggtcacatcgaactggcttctccaactgcgcacatctggttcctgaaatcgctgccatctcgtatcggtttgctgctggatatgccattacgtgacatcgaacgtgtactgtacttcgaatcctatgtggttattgaaggcggtatgaccaacctggaacgtcgccagattctgactgaagagcagtatctggatgcgttggaagagtttggtgatgagttcgacgcgaaaatgggcgccgaggctattcaggccctgttgaaaaacatggatctggaagctgagtgcgagatcctgcgtgaagaattgaacgaaacaaattctgaaaccaagcgtaagaaactgaccaagcgtatcaagttgctggaagcgttcgtacagtctggcaacaagccagagtggatgatcctgaccgtgctgcctgtgttgccgccagatctgcgtccattggttccgttggatggtggtcgctttgcgacttccgatctgaacgatttgtatcgtcgcgtgatcaaccgtaacaaccgtctgaaacgcctgctggacttggcggcaccggacatcatcgtacgtaacgaaaagcgtatgctgcaagaagcagtagatgcattgctggataacggccgtcgcggtcgtgcgattaccggctctaacaagcgtccgttgaagtcactggctgacatgatcaaaggtaagcaaggtcgtttccgtcagaacttgctgggtaaacgtgttgactactcaggtcgttcggttatcaccgttggtccatacctgcgtctgcatcagtgcggtctgcctaagaaaatggctcttgagctgtttaaaccgttcatctacggcaagctggaattgcgtggtcttgctaccaccatcaaagccgccaagaagatggttgagcgtgaagaagcggttgtttgggatatcctggatgaagttatccgcgaacacccagtactgctgaaccgtgcaccaacccttcaccgtttgggtatccaggcgtttgaaccggttctgatcgaaggtaaggcaatccagttgcacccattggtttgtgcggcatataacgccgacttcgatggtgaccaaatggctgtccacgtaccgctgacactggaagctcagttagaagcgcgtgcgttaatgatgtctaccaacaacatcctgtcacccgcgaacggcgagccaatcatcgttccttctcaggacgttgtattgggtctgtactacatgacccgcgactgtgttaacgccaaaggcgaaggcatggttctgactggcccgaaagaagctgagcgtatttatcgcgctggcttggcatctctgcatgcccgcgtaaaagtacgtattaccgaagaaattcgtaataccgaaggcgaaagcattacgcgtaccagcattatcgatacgactgtaggccgtgctattttgtggatgatcgtcccgcaaggcctgccttactctatcgttaaccagccgctgggtaaaaaagctatctctaagatgctgaacacttgttaccgcatcttgggcttgaagccaacggttatctttgctgaccagatcatgtacaccggttttgcttacgcagcacgctcaggcgcctctgtaggtatcgatgacatggttatcccagaagcgaaagcggggatcatcgaagaagctgaaactgaagttgctgagatccaagaacagttccaatctggtctggtcacggcaggcgaacgttataacaaagtgatcgatatctgggctgcggctaacgaacgtgttgctaaagcgatgatggataacttgtcggttgaggatgttgtcaaccgtgatggcgttgttgaacagcaagtttcattcaacagcatcttcatgatggccgactccggtgcgcgtggttctgccgcacagattcgtcagctggcaggtatgcgtggtctgatggctaagccagacggctcgatcattgaaacgccaatcaccgcgaacttccgtgaaggtttgaacgtacttcagtacttcatctcaacccacggtgcgcgtaaaggtttggcggataccgcattgaaaactgcgaactccggttacctgacccgtcgtttagttgacgtggcacaggatctggtggtgactgaggatgattgtggtacccataacggtatcgtgatgaccccggttatcgaaggtggtgatgttaaagagccactgcgtgatcgcgtactgggtcgtgtgactgcagaagaagttatcaagccaggttcggctgatattctggttccgcgtaacaccctgctggacgaaaaatggtgtgatctgttagaagaaaactccgtcgacagcgttaaagttcgctctgtagtaagctgtgaaactgacttcggtgtgtgtgctaactgctatggtcgcgacctggcacgtggccacatcatcaacaaaggtgaagcggttggtgttattgcagcacagtccatcggtgagccgggtactcagcttacgatgcgtacgttccacatcggtggtgcggcatctcgtgcggcagcagaatccagcatccaggttaagaacaaaggcagcttgaaactgagcaacgtcaagttcgtgaccaatgcggctggcaagctggttattacgtctcgtaataccgagctgaagctgatcgacgaattcggtcgtaccaaagaaagctataaagtgccttacggtgcggtaatggctaaaggcgatggcgcagaagttcagggcggcgaaaccgttgctaactgggatccgcacatcatgccagtggtcaccgaagtgagcggcttcattcgcttcgccgacatggttgatggccagaccattactcgccagaccgacgaactgactggtttgtcttctctggtcgttctggacagtgcagagcgtacgggtagcggtaaagacctgcgtccagcactgaaaatcgttgatgccaaaggcaatgacgtattgatcccaggtactgatatgcctgctcaatacttcctgccaggtaaagcgattgtacagctggaagacggtattcagatcggtgcgggtgataccttggcgcgtattcctcaggaatcaagcggtaccaaggatattaccggtggtctgccacgtgttgctgacttgttcgaagcacgtcgtccgaaagagcctgcaatcctggctgaaatcagcgggatcatctcgttcggtaaagagaccaaaggcaagcgtcgtctggtgatctcaccgttggatggtagcgatgcatacgaagagatgattccgaaatggcgtcagcttaacgtgttcgaaggtgaagttgtggaacgcggtgacgtggtttccgatggcccagaatctccacatgacattctgcgtctgcgtggcgttcacgcggttacccgctacatcaccaacgaagtgcaggaagtttaccgtctgcaaggcgttaagattaacgataaacacattgaagttatcgttcgtcagatgctgcgtaaaggcactatcgttgatgcaggtagcaccgacttcctggaaggcgagcaggcagaaatgtcccgcgttaaaatcgctaaccgtaagctggcagcagaaggcaaaattgaggctacgttcactcgtgacctgctgggtatcaccaaggcatccttggcgaccgagtccttcatctctgcggcttcgttccaggaaaccacgcgcgttcttactgaagcggcagttgccggtaaacgtgatgaattgcgtggcctgaaagaaaacgtaatcgtgggccgtctgatcccagccggtaccggttatgcttatcatcaggaccgtatgcgccgtaaagcacagggtgaagcgcctgttgttccacaagtcagcgcggatgaagcgactgcaaacctggccgaattgcttaacgccggttttggtaacaacaaaggctaatctctttgcctactaccaacaaaaaccgcatctttcgggatgcgggtttttgagagacgaacggccccttctcgggccgtttttttttgtttatttttagagtaagtcgttttttttagagcgttttgtttttgttagagtaaattttgtttgtttttagagtcaatgtcgtccccctgaatttagtcttgccgcttaatggtgttctctggttaaaacaaaccgccaagagtgtcatgccagccagtggtgtaactcactgatattacgccttcgggcggtttttcaatattacgtgaactcgcttatcgcaatgaacggcctaaatggctatcccaatctttccacacgggctgtaagcctgcttttgttaacgcttgtgcgacctgttccggggagcggttatcatggggcgcaaattgttccagttcgggatgatcatcggcataaccccccggttgggtttttgacccggcactgacattattgatagcaaccggaatgacattatcgcggaagaaaggcgattctcgagtagataacgacagttccacatcaggtgcaaataagcgaaaagcgcagatcagttgcagcagttgtggctcactcatgatggatgcgggctcgatccccccagcgcacggacgcaagcgagggaaagagatcgaataacgggtttgccagtaagtttgttgcaaataaaacagatgctccgccagcatataacagtcggtacgccaactattggacaagccaatcaaggcacctaatccgatcttgtcgatccccgcacggcccaaacgatctggggttgccaaccgccagtgaaaatcctgcttatgaccccgcaaatggtgctgctgatacgtcgctgggtgataggtttcctgataaaccatcacgccatctaatcccagcgcctttaattcagtatattcatcttctgccaatggctgaacctccatcattagcgaactgaatctactgcggatcgtagggaggtggcggcgaaaatagtccattcctacttttgtttggtgctccccagtgaccagcagcaagtgctcaaaacccagcgctttgatagcttcacactctcggataatctctgcttcatccaatgtcttgcgtttgatgcgattactcatcgagaagccgcagtaagtgcaatcattagcacacaaattggagagataaagcggcacataaaaactgactgtatttccaaaacgttggcgtgtcagttgttgggccttctgtgccattggctccaggtaagccagtgcggcaggggaaatgagtgccatcaaatcttcgcgggtgggcttgatggcattcagcgcccgttcaacgtctgcgggttttttactgttgatggttaaggagatatcgtcccagtccaactgctgccagcgctggttgaagtcttcagacatggtcttgctcctcaagttggctgaggaaacccgttagcgggctggtggcggtggcccgtagttgtaatgtatcaggttgtgaaggattgaacggtgaagcgccaagcccagccaagcgtgcccgttcgccagattcaaccgccagccggaaagcatgggccatctgcaccggggagtgagctacggcaattgcggtattcaccagtacggcatcggcacccagttccagcgcttcaagggcatggctcggtgcaccaatgcccgcatcaacgacgaccgggactttcgattgttcgataataatttgcaggaagtcgcgagtacgtaaccccaaattagatcctatcggtgagcctaatggcatcaccgcagcacaacccacttcttccagtcgtttacacaagacggggtcagcaccacagtaaggtaaaacaacaaacccctctttcaccagcacttcggcggccttgagcgtttctatcgggtcaggcagcaaatatctcacatctggatgaatttccagttttacccaatgggtattcaaggcttcgcgggccagacgtgcggcaaaaatagcttcctcagcggttttggcaccggatgtattaggcagtaagcgcacgcccaactgccgcaagggtgcgaggatcgcgtcgtttcctgactgtaagtcaacgcgcttcatggccatggtaataagttgtgaacccgaggcgcggagtgcttccagcatcagttcgggagaggagaacttccctgtgcccgtaaataaacgagaagtaaaagtggtatcggcaattttcagcatgtcagcctccggcaatggcttggaacagcaaaatatgatcacccgcttgcaaccgatgattttgccaatcggcgcgcggaataatgacctgattaatagccagtgcggttcccggctggtggtgtttaagctgattaagcagcatctcggcggtgagattgcactccacctctaatggctggtcattgagcatgattggtatgtaattggtcttcacaacccacctccacacgccgggcaatgggctgcccttgtcagttgcagggtgctccaactctgctgtttgccatcaaatagccgcaatttaccgctcagtgctaatggtattcccgcgagcattttaatggcttccagcgcctgcaaggtcccgatgacaccgaccaccggccccagaacacccgcggtacggcagttacgttgaggcaactctttatctggataaatacaggcgtagcagccttgggcatagggcggttcaatcaccaacagttgtccactgaaccctacagcactgccgctgattagtggtttttgtgccgtgacacaggcggcatttacctgatggcgtgtctccatattgtcactgcaatccagcactaaatctgcattagcgacagcatcggtcaatacttgtcctgtcagccgtgtatccagtgcgacaatgcggatctgtggattgagttgctgcaaatggcgttgcgctaaccgggccttgttgtggctaaccgatgaggtggggttcgataacgtttggccgatatctgctgtacgatacagaatctggcgctgcaaattagtgagatccaactggtcatcgtctgccagcagtaactgaccgacaccggcggcggccagatagagcgctgcgggggagcccagcccaccgaggccaacaatcagcacactggcaccctttagctttcgttgcccttccgggccgatatcttccagtagcagttggcggctatagcgtaaaaattcactgtcacttagcgtctggtcatttttcatcagccagctccttaccctcgatcaggtgcagtaattgtgcggttgcccgttgccagtcacttgccaacgtaatggcgctgaccacggcgacactgccgacgccagttgctaatacgtgtggcacccgctcaatactgatgccaccgatagccacggttgggtaatccggcgtattcttcacctgacggcttaaagacgccaacccctgtggggatgacggcatctgtttggtctgagtagggaaaatatgccccagcgcgatataagaggggcgcagtgtttttgccaccgccaactcatgttcatcatgggtagaaatgccgagccgtaaccccgcttgctgaattgccgctaaatcagcggtttccagatcttcctgaccgagatgaacgccataagcgccgtgtttaaccgccaactgccagtaatcattgataaataagcgcgcctgatagcgttttcctaattcaatggccgcgacaatatcttgctccacctgagcatcgtctgcatttttaatgcgcagttgtagcgtcgtgactccggctgccagcaggcgttctatccataataatgagtccaccactgggtagagcccaagacgctgttccgtggaggggaaacctggtgtagccacaggagagagggcatcaagttggctcattattggcctccgcactcagattcgccgggcggtggtatagctcactgccacgggagcgaaactcggctgacattttttccatccctgattgcagcatattaattggctgcgtgatgtctattggttgtgctgcggtggttggtgtagcagcttgtgcttgtgcggccgcttgttcttgtgccgcagcataatcgcggacctcttgtgagattttcattgaacagaatttcgggccgcacatggaacaaaaatgagcgactttcccggactcttgcggcaaggtttcatcgtggtaagcgcgggctgttgctggatcaagcgccaaattgaattgatcttcccagcggaactcaaagcgagctttggacatggcgttatcacgaatttgcgcaccggggtggcctttagccaaatctgcggcgtgcgcggcaattttgtaagtaataagcccctgtttgacatcctctttattcggcagaccaaggtgctctttgggggtgacataacagagcatggcgcaaccgaaccagccgatcatcgctgcaccaatccctgaggtaaagtggtcatagcccggtgcgatgtccgtggtcagtgggcctaaggtataaaatggcgcttcgtggcagtgttccagttcctcggtcatattgcggcggatcatctgcatcggcacatgccctgggccttcgatcatcacctgtacatcatactcccaggcgattttggtcaattcacccaaggtatgcagttcggcgaattgggcctcatcattggcatcttgaatagagccagggcgcaggccatcgcccagtgataatgaaacgtcataggctgcacaaatctgacagatttcgcggaaatgctgatacaggaagttttcctgatgatgcgaaaggcaccattttgccataattgaaccgccgcgagagacgataccggttaggcgtttggcagtcatcggcacatagcgcaacaagacccccgcgtggagagtaaaatagtctaccccttgctctgcctgctctaacagggtgtcacggaacatttcccaggtcaggttttcggccacgccattaactttttccagcgcctgatagataggtaccgtgccaatagggaccgggctgttacgtaggatccattcccgcgtttcatgaatatagcggcccgtagataagtccatcaccgtatcggccccccagcgggtagaccagaccagtttttctacctcttcttcaatggaagaggtcacggcggaattaccgatgttggcattcactttgaccagaaaattacggccaataatcattggttcagattctgggtgattaatattggcggggatgatggctcggccggccgccacttcctgacgcacaaactcggcggtgatattttccggcagatgggcaccaaacgcttgtcccggatgttgttgaagcaagacttcaccccgaatacgttcacggcccatattttcccgtagggcgataaactccatctctggcgtgattttcccctgtcgggcgtaatgcaactgagtcacacattgaccagtggctgctttccgtgggcggggtagatgctcaaaacgtaaatggtccaggccttcatcagccaaacgctgttgggtaaagccggaactgacagatgccagcgcttcagtatcttggcgatcagcgacccaagcggcacgcagtttaggcagcccgttgtgaacatccagtttagcttgtgggtcaccatagggaccggaggtgtcatagaccgggatggcctcattatcttcatagcgtggttcgtttttactgccgccgatttgcgtcgggctgagttggatttcacgcatcggcacttgaatatcgggccgagagccttgtagataaatacgttgggagttggggaaagtaacgccttgtaaggtattaataaactgttgggcctcttcgcgctgctttttacgaataggtgtgcctttacgtgggtgtgacgaattttcagcgggtaatgacgttgtattattagacatagcaattcctaccagtgtggtttatagagccagtgtggtgtattgggaaaattgcttgtctggagcttggcgggagtaacgatgttggccagtgaccggtagctaccctgagggtgagtatcgggcctgtagcgataaattactcttgttcccttcgcgggtattaacccgatcaggttccgcggatcccgaattaacggtctcagcctgcgtttgctttcctaaaaaagcaggtgctaggcactccgacaagagtctttactatacgaggttgaattaaaactacaagagcctacttatgagctggctattctgcttgctcattttatgcgtgctacccgtatctgctgtttattcgcagttacaggcggcggtcagttgacctggctctttttatccgcatccgctagctgggcggcttgccaagattcggcggcccattgaattaattggtcttccagcttgaaacgggcgtcaagcgcttcaccgatatccgataaagcttgttgatactcggtgcagctatcgtcgtcgatttcaatgtttgtatagcgatcatggaatgccatgatagtttgagtgttgttttttaatgcaggatgaattttggcggtcagtgccatttttgggctagatgcgccttccacctctttgataattctgtcatagatatggaaatggcctgaagaaagatagtcgactaaattatggcaaaagttctccagcgtttttgcattaagcggggtatgcttctctttttgcggcttaataccgatcacggtgcaataagagactaaaagttctttacgcgcatgaagccattgatcaattaattcattactaccgccaacgcgttgagtcaggctttccagtcggttgagcatgaacgactccattagtaagaaaaaatattgtgggttacaaaaatgtaacagccggtttctagattgccagtgaaatagaggttgtgcaacaacgatatggaactacaacttacaggtaaagaaagtggctggtggattgtcagtcatgaaaataaattatggttgccgaagggagagctaccacaaggcaatgccgctaattggtcactgcaaggcgcgactgcacggcagattggtgaatggcaagggcagcctgtgtggcttattcgccagatgatgccttcagggatggggtcggtccggcaattattggatgttgaccgcggtttatttcagttggcagggcgcggcgtgcaattagccgaattctatcgttcacatcgcttttgtggctattgtgggcatgaaatgcatgccagccggacggaatgggccagcttatgtaaccactgccgggagcgctattatccgcaaattgccccctgtgtgattgttgctattcgccgtggtgatgaaattttgctggcacaacatgtgcgccatcgtggcggtatcaataccgtgctggcggggtttgttgaagtgggggagaccctggaacaggcggtttcacgggaagtgttggaagaaagtaatattcacattaagaacctgcgctacgtgacgtcacagccttggccatttcctcattcactgatgatggcatttatggcggattatgacagcggtgaattatgtcatgacccgaaagagttgctgaatgccggctggtatcgctatgaccaattacctttgctacctccacccggtaccgtggcacgccgtctgattgaagatacggtggtcttatgtcgtgaacatagcgatttaagccaatagcattttaaaatcaatatcttgctattgcttgtgaaagaaaggggggatgcaatgacgtactttctttatttctaatccataggagtaaaaaagtgcgtccaatcataactcagaccgtgcaaccagtgacttcgatgtatccatcactaccaaaagcctttatccaagataaggttatgttatcgctacataataaagctgcgttagacagcaccattaaaggcgacgcagtgagagctcttctcttacacgcttatgtagatatcaaaggtaatgaagtggaaaggcgcaccactgcggtaggtattcaaaagctctatgaggaagtattgcaggaattgttatatcaggatcctaagtgtatatcagtcatgatatcgcacaccgctaacccaccaacccccctgagtattgctagccctgagcgagtgatgcagatgatgcaccagaatattcggcaggatattgccagccaaaaaacaataactgaccgcacgcagactctccataatttactgtcgtataagaatcaatttcaatataaagccatctatgaccagccaagattaaagcctgaagaaaactataactttaagatggttaatgatgtacatgaaaatctgcattctattcaaacagacagctgttgtaaggctggagcgttaacgggtgctacctattttctacaagactctccaggggaaattcatgtatttggcattcgcattactcaagcgaatgaagaaagcgggaaggttgaattatttcagggtttgaaaagtgatgttcaaacaaacaataaactggactcgttgtacctattgttgcgcgggaatagccaccaatctcccgatgatatctcgagttcagtcggttgataatgagcaactcaagagggtgattcaggaaagagccatctgacatgctacaattccgttttgtaatataatgccactttataatacaaggccgtcagatcattaagggagccctatcatgaatgagttgaaaaacgatcgctatctgcgtgctttgctacgtcagcctgtagacatgacaccggtatggatgatgcggcaggcaggccgttatttgccagaatataaagcaacccgcgctattgctggggattttatgtcactgtgcaaaaatgcagagttagcctgtgaggtcacgatgcagccactgcgtcgttatccgctggatgcagcgattctgttttccgacattctgaccatccctgatgccatggggctggggctctattttgaaactggcgaaggcccgcgttttcaatccccaattacttgccgggctgatgttgaaaaattgccgatccccgatcctgagcaagaattgggttatgtgatgaatgcggtgcggaccattcgtcgcgaactggccggttcggtgcccttaatcggtttttccggtagcccatggactctggcgacctatatggttgaaggcggcagtagtaaagcctttaccaaactgaaaaaaatgatgtatgccgaaccgcagaccttgcacttgctgctggataaactggcagacagtgtcattttgtatcttaatgcccaaatcaaggcgggggctcaatcggtcatgatctttgatacttgggggggggtactgacaggccgtgattatcatgagttctcattgaattatatgcataaaattgtcgatggtttgatccgcgaaaatgaaggtcgtcgggttccggtcactttgttcaccaagggcggggggcagtggctggaagcgatggccgccaccggttgtgatgcgctgggtctagactggacaacggatatcgcggatgcacgtcgtcgtgttggtgataaagttgccttgcaaggcaacatggatccttcggttctgtatgcaccccctgcgcgtattgagcaggaggttagtaccattctggcgagctttggccagggtgaagggcatgtgtttaatctgggccacgggattcatcaagatgtaccgccagcacatgccggtgcatttgtgaacgcggtacatgcgctatcacggccttatcatcaaaaataatcagcgtgtaggatggagccgattggtcaatggtgaagactaaatcgagggttgagactaaatcaatgtttgatactaaagcgctacaggcagagcagcggcaacgggcatcggagattagtcttcatgatggcattgataaccagtttgtgcgctttattgctggagctgatgtcggttttgagcagcatggggagataacccgtgccgctatcgctattttacgctatccctctctggcgctggtggaataccaggttgccagagtggcaacttctctgccttatatccccggtttactctcttttcgtgaatatccagcgctgttagccgcgtgggcgcagttgcagcaacgccctgatctgattctggtcgatgggcaaggcatcgctcatcctcgccgtctcggcgttgccagccattttgggttattggtcgatgtaccgacgattggtgtcgctaaaagccgcctgtgtggtgatttcttgccactgcatcaagatgttggtgcggtgcagcccttgttcgataacgatgagcagcttggttgggtatggcgcagtaaaatccgctgtaacccactgtttatttcgcctgggcatcgggtgagtgttggcagtgcgctggcatgggttcaacgttgtatggcgggttatcgtctgcctgaaccaacccgctgggcggatgctattgcttcaaaccgtccgcaatttcaacgttggctgcggaaaaatcctgattttcttggcaagcgtagggatatgatttaatttcggttacactgccgcgcagataatgaataatgagaactcatcatgttacgtaatccgattcatctacggctcgaaaagctggaaagttggcaacatctgacttttatggcttgcctgtgcgagcggatgtatcccaattaccagcaattttgtctggaaaccggatttggcgatccggcggtttatcgacgtattctggatcttatctgggaaacgttagtcgtcaaagacgctaaagtgaactttgatagtcaattggaaaagctggaagaggctattccatcatctgatgactatgctatctacggtgtttatcctgctattgatgcgtgtatcgcattaagtgaggctattcattcacgtttgagtggtgaaacactggaacatgccatcgcgatcagcgaagcatcaatccgtactgttgcgatgctggaaatgacgctggcaggtaaagaaatgaccgatgaagaactaaaaatcttgcctgcgattgaagaagaatgggatatccagtgggagatttttcgtctattagctgactgtgaagagcgcgacttagatctgatcaaagggttacgatctgacctgcgggaagccgctgttagcaacattggcataaatttaacgcaataaggcaagaaaacgtgatttaacgcctgatttgtcacgtcttaaggcttcacatctgccccctgtctgttctacatttggggggcgatttaaaagtggctatcggtgcgtgtatgcagggagtgctgtccatcggcatatccgtcgcacttgatgctttgcaaacgataaatatactgtaaggataacgtatgaataagactcaactgattgacgtaatcgcggacaaagcggacctttctaaggtacaagctaaagctgctctggaatccacactggctgcaattaccgaatctctgaaagaaggggatccagtacaattggttggttttggtaccttcaaagtaaaccatcgtaatgagcgcactggccgcaacccacaaacgggtaaagaaatcaaaattgctgccgctaatgtacccgcgtttgtttctggtaaggcactgaaagacgctgttaagtcatagtgtgtcagtaaaaataataagcaggggggggataaaaccccttttgtttatgcggcgggtgctgataaccttcggattaaccttgggtctcagcgcctgtagcagcctgtcagatccccctcaattcagtgccagcgggtatatcgccgatagcggtgttgttcgtttatggcgtcaggataatgcgcagcagcaaccccaggtgttgatgagcgtttacagtccctacttcgggggcaatacccgagtgaccttctacgagtaccagaatggcattttacgggaaatccgtcgcaatgatttaggcgctaccccacagagtgtccagttgcgtttcgatgagcaagggcaggttagctttatgcaacgccagctcgcatcgcgtcgtgagtcgctctctgctgatgatatagcggtttatcagttggaagctaaacgcattttggaactcagtcgtgtgctacgtgcgggtgacgtaaggttaattcaggggcgttggcaggatggcatgcttactacctgtgcaggtaaaacgttgcgtctgaatctggatgataattcgcaggcatggctgaccacgcggggtgagaagaatacgcagcctcttggtgtcgcatggctggattcatctgaagggcaacaacttctgctggtcgcgaatcaggacttctgtcgttgggaacctcaggcaggcagcctgtaagttaccgatgagctataagttaaccaatgagctataagttaaccaatgacctataagttaaccaatgacctataagctgctggttatcagcggtgcagcgtcataagatagccagtaatcgattatgatccgcaataagtagggcacagcgcactagactgtacccttttaaagacagtgagcctttacttaccgcgagcaatcgctcgataaccgatatctttacggcagaaaaccccttcccactggatcccctcagctaactgataggcatattgttgcgcctgcgcgacggtttcaccgagtgcagtgacacacaagacgcggccaccattggtgacaacttcatgatttccattcagcttggtccccgcgtggaagacttttccatccttgacttcttgctgtggtaagccatgaataacatcaccctggcggtaatctgctggataaccgccagcggctaaaacgacccccagtgatgggcgctcatcccagtctgaggttttttcatttagtttgccttgtgtaccggctaaacacagttcgaccaaatcggagcgcatacgcaacatgattggctgcgtttctggatcgccaaagcggcagttgaactcaatgactttgggttgcccatcggctgaaatcatcaggccagcatagaggaaaccggtgtaaatattaccttccgccgccataccacgcacggtcggccaaataacctgatccatgacccgttggtgaacatcatctgttaccacgggggctggggaataagcacccattccgccggtatttggcccggtatcaccatcgccaactcgcttatgatcctgactggtcgccattggcaaaacattttcgccatcaaccatcacgataaagctggcttcttcgccatcaaggaactcttccaccacgatacggtgccctgcatcaccaaaagcgttaccggccaacatgtcatttacggcggtttcggcttcttccagcgtcatcgcaacaatcacgcctttaccggcggccagaccatcggctttgataacgattggcgcacctttttgacgcacataggccaatgcggcctcgacatctgtaaagttttggtattccgcagagggaatgttgtgacgggccaggaaatctttggtgaaggctttagaaccctctaattgagccgcagcctgagtcgggccaaaaatagctaaaccagcagcgcggaacgcatcaaccacgccgatcaccaaaggggcttctgggccaacaatcgtcaggccgatatcatgactttgagcaaaggccagtaaaccggcaatatcagtggcggcgatatcaacattttctaaggtcggttccagtgctgtacccgcattacctggtgcaacataaattttgtccgctaaaggagattgggcggctttccagcccagagcgtgttcacgaccgccgttaccaattatcaaaatattcatctggatgactccgtgaagaggcacatcatcaagcgccccttcctatataagagggttaattaatgacggaaatggcgcatgtcggtgaagatcatggcaataccgtgttcatcagcagccgcgatgacttcatcatcacgaattgagccgcctggttggatgacacaagtaatgcccacagccgcggcggcatcaataccatcacggaacgggaagaaggcatcagaggccatggctgagccagccacttccagcccttcatctgcggccttgataccggctattttcgcagagtacacacggctcatttggccggcacctataccgattgtcatgttatcgcgggcatagacaatcgcattggatttaacaaacttagccactttccagcagaacagcgcatcacgcagttcctgttcggtaggctgacgcttggaaaccacgcgaaggtcggccgccgtcaccatacctaaatcgcgttcttgtaccagcaaacccccattaacacgtttgaaatctaaacctgctgaacgtgcttgccactggccacaagtcaggacccggacattttgtttagctgcaagcaatgccaatgcatcagagctgactgttggcgcaatgatcacttcgacaaactggcggctgatgatcgcgttggccgttgctgcatccaattcacggttaaaggcgatgatgccaccgaaagctgaggttggatcggtttgataggcacgttcataagcggcaagaatagaatcaccgatagccacaccgcatgggttggcatgtttaacgatcacacaggctggttcactgaactctttcacgcattccagcgcggcatcggtatccgcaatattgttataagagagggctttcccttgtaattgctgggcagtggcaacggatgcctctttgacatcttcttctatatagaaggcagcttgctggtggctgttttcaccgtaacgcatatcctgcttctttatatagttaagatttagggtgcgagggaagtggccggaaggctgttccgtatcaccatgataaggtggcaccagcgtaccgaagtagttggcgatcatgctgtcgtaggcggcggtgtgttcgaaagctttaatggccagattgaagcgggtggggtaagtcaacgaaccatcattattatcaagctcagtaataatggcggggtagtcgctactcttcaccacgatggcgacatctttatggttcttggccgcagagcgaaccatggttgggccaccaatatcaatattctcaaccgcatcttccagcgagcaatccgggcgggcaaccgtttgggcgaagggatataaattaacgacgacaatatcaatgggctgaatgccatgttgagccataatgccatcatcttggccacgacgacctaaaatcccaccatgcacctttggatgcaaagtcttcacacgtccatccatcatttccgggaagccggtgtagtcagacacttcggtaacgggtaaaccagcatcagccagcaggcgggcagtcccaccggtggaaagtaactcgataccgcgttgagaaagtgcttgggcgaattcgatgatacctgctttgtcagacacactgagtagagcacggcggattggacggcgttgttgcatggttttatcccttggatttggagtcgcagttttcttcatttattaattacagagttcttcactatcaattaatagggcgctacagaatcaattaatagggcgctacagactatttcgttgatattttgtcgatgaggtcacccttttcgacgcggggaattgtagcgaaaacgattgcgtgatgctcgtcaattttgagcgcagattcaatctgtggataagtttgtgcacaactgcgtataaggcggggttttgctgtggaatgcagcaaacagtcatttttattgaaaatagcggttgcgggctgcgtggaactccctataatgcgcatccatcgagacggcacacaacgaatcaaatcgttgagtggccggcaaagagaacagagaaattcaacgaaataagtagttgactctgaatgaggaaagcgtaatatgcgcacctcgcgttaccaaccaagtgttgctaacgcactgctctttaacaatttatcagacaatctgtgtgggcactcgcaagacgatatcgacgcctgtttcggcaggcagaaataatatcaagtcttgaagagtgaccaaagcagtaaacattgtgacttcggtcagaatgcctatttgcagaaagtaatctttgagcaccgctgcttttacgcaagtaaaagtcagcaaatcaaacaaatcttaaattgaagagtttgatcatggctcagattgaacgctggcggcaggcctaacacatgcaagtcgagcggcagcgggaagtagtttactactttgccggcgagcggcggacgggtgagtaatgtctggggatctgcctgatggagggggataactactggaaacggtagctaataccgcatgacctcgcaagagcaaagtgggggaccttagggcctcacgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggttgagtttaatacgctcaatcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagagatgctttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagccagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaacgatacgcattgcgcagtgcccacacagattgtctgatgaatgtaaacgagcaagagcacctgttgatgttatgagtttcgactcatgctgatacgaaacggttgaatttcggtttgatcggtattttcgtgtccccatcgtctagaggcctaggacactgccctttcacggctgtaacaggggttcgaatccccttggggacgccaatccgataatgagtgaaagacattatcaccggttctttatgaactgaaaaataacgtaaagatgactttaccaagtcgtgtttacgatattgctctttaacaatctggaataagctgaaaattgaaacattacagctgaaatttaccccgccgtagatgtattggggtaaagagtaacctgtaatagagtctctcaaataatcgcaacacaagatgtactgtcagcaatgacaagacaccttcgggttgtgaggttaagcgactaagcgtacacggtggatgcctaggcagtcagaggcgatgaagggcgtgctaatctgcgaaaagcgtcggtaagctgatatgaagcgttataaccgacgatacccgaatggggaaacccagtgcaatacgttgcactatcgttagatgaatacatagtctaacgaggcgaaccgggggaactgaaacatctaagtaccccgaggaaaagaaatcaaccgagattcccccagtagcggcgagcgaacggggaggagcccagagtctgaatcagtttgtgtgttagtggaagcgtctggaaagtcgcacggtacagggtgatagtcccgtacaccaaaatgcacaggctgtgaactcgatgagtagggcgggacacgtgacatcctgtctgaatatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagcaccttcgtggtgtgactgcgtaccttttgtataatgggtcagcgacttatattttgtagcaaggttaaccgaataggggagccgtagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatcttcgggggtagagcactgtttcggctagggggccatcccggcttaccaaaccgatgcaaactccgaataccgaagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacacttaggtgttgttgggtaggggagcgttctgtaagccgttgaaggtgacctgtgagggttgctggaggtatcagaagtgcgaatgctgacataagtaacgataatgcgggtgaaaaacccgcacgccggaagaccaagggttcctgtccaacgttaatcggggcagggtgagtcgacccctaaggcgaggctgaaaagcgtagtcgatgggaaacaggttaatattcctgtacttggtgttactgcgaaggggggacggagaaggctaggctggccgggcgacggttgtcccggtttaagcgtgtagggggagtgaccaggtaaatccggttgcttatcaaccctgaggcgtgatgacgatgcactacggtgcagaagcagttgatgccatgcttccaggaaaagcctctaagcatcaggtaacattaaatcgtaccccaaaccgacacaggtggtcaggtagagaatactcaggcgcttgagagaactcgggtgaaggaactaggcaaaatggtgccgtaacttcgggagaaggcacgctggcgttaggtgaaaggactagctcctggagctgaagccagtcgcagataccagctggctgcaactgtttaataaaaacacagcactgtgcaaacacgaaagtggacgtatacggtgtgacgcctgcccggtgctggaaggttaattgatggggtcagccgcaaggcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtggggaggccttgaagtgtggacgccagtctgcatggagccaaccttgaaataccaccctttaatgtttgatgttctaactcggccccatgatctggggtgaggacagtgtctggtgggtagtttgactggggcggtctccttccccaaagagtaacggaggagcacgaaggttagctaatcacggtcggacatcgtgaggttagtgcaaaggcataagctagcttgactgcgagagtgacggctcgagcaggtacgaaagtaggtcttagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggaagattgagaggggctgctcctagtacgagaggaccggagtggacgaatcactggtgttcgggttgtcatgccaatggcattgcccggtagctaaattcggaagagataaccgctgaaagcatctaagcaggaaacttgcctcgagatgagtcttccctggggcttaaagccccctgaaggaacgttaaagactatgacgttgataggctgggtgtgtaagtgcagcgatgtattgagctaaccagtactaatgatccgtgaggcttaaccttacaacaccgaaggtgttttgaattgagagagattttcagcgtcgttccgagattgtgttgactggctgacaagtgttgcttgtttgcgggttaattgaaacagaatttgcctggcggccatagcgcggtggtcccacctgatcccatgccgaactcagaagtgaaacgccgtagcgccgatggtagtgtggggtctccccatgcgagagtaggacactgccaggcatcaaataaagccaagaccccatgcccaaagcgtggggtttttgctgtgtgcgaaacacagaaattacgcgttttactgataaccccatgccaaaggcgtggggtttttgctgtgtacgaaacacagaagttacgcgttgtaatgatgattaaaatggtgaggataaggtaggttagcaacgtgtccacaccaatgatggcgtagctcgagcctatatggagcaggaaaaacggtatttttactggctgtctattctcttcgccgcgggcatttggtcatcaacctcagaaacttcactttttgtgatagatattctccttgatcttcccccttagttcagtaccgctgtaaagtagagttttcggcccttcttttccgtccaaaaaggggtcattcgttatgaaaaagacgcgttataccgaagaacaaatcgcttttgcactcaaacaggctgaaacgggtactcgagtggaagaagtctgtaggaagatgggcatttcggaagcgacattttacaactggaagaagaagtttgggggaatgggtgtcacggaattgcgccgtcttcggcagcttgaggatgagaatcagcgcctcaaacgtctggtggccgatctgagtctggataaggaaatgctgcaggatgtcatccgaaaaaagttctgaggccgctgcagaagcgtgatgccgtggaatatctgctggcggcgtaccgtatcggagtacgcagagggtgcaggctgatgatgcagagccgcactgtatacaactatcgtagccatcgtgacgatcgggctattactcagcgaatacgggaaattgcggagacgcgcatccgttatggctgtccgcgcattcatatcctgctgcggagagaaggctggcttgttaaccataagaaaacgcaccgtatttactgtcttgagggtctcaatctacgttcgaaacgtccacggcggcatgtgacagcgaagcacaggcacgcacgtccagaagtgaccgcgttagagcagtgctggagcatggatttcgttgctgataatctgttcaacgggcgtcgggtcagggcgctaactatagtggataattttagtcgtgaatgtctggcgatcgaggtcggtcaggggttacgtggagatgatgttgtggctgtcatggacagattaaaacattcgctggggcgtattccacaaaggctgcagacagataacggcagcgaattcatctcgaagtcgatggaccgatgggcgtatgaaaacagggtcacgatggactgttcacgccccggaaagcctacagataatgcctttatcgagtcatttaatggcagtctgagggatgaatgtctgaacgtgcacgggttcctttctctggaagatgctcaggagaaaattgaacaatggcggcaagaatataatcattttcgtccgtattcttcgttaaataacctgactccggcagaatttgctcgaagtcatcaaaaaggtccggatctctgatttagcctggtacggatattggggagggatcatcctctccttattattttgttcgtcgcggcccttgagtggggatactgtgggtataatcgatcaccgggagaagcggtatggcggcgtatagccctgcacgattatttcatatcacatggctaaatatggcaccgacaaaaaattccgctccacagatatttccctttcataatttttcttccacacactattcactctaataatgtgagctaatgaccctgttttgccatcgagtgtgatcccaagcctcataatatttttattttgactgtttttataacgtcagccacagatgtcaacgacggatgaaaagtgatccacttatatctccaccaacggcccaatattgatccaccgttttactcaggattagcttctgctataaccccggcctttcgtttctgtctgagtcgatagctttctcctttgatttgaacgacatgtgagtggtgtaagatacggtccagcatcgctgaggtcagtgctgcatcaccggcgaacgtttgatcccactgcccgaacggcagattggatgtcaggatcattgcgctcttttcgtaacgtttagcgatgacctggaagaacagctttgcttcttcctgactgaacggcagatagcctatttcatcaatgatgagcaggcggggggccattactccacgctgaagcgtcgttttataacggccctgacgttgtgccgtagataactgaagtaacagatctgctgctgttgtgaagcgaactttgatacctgcacggactgcttcatagcccatcgctattgccagatgggttttccccacacctgatggccccagtaatacgatattttcattacgttctatgaagctgagtgagcgtaacgactggagttgcttctgcggtgctccggtggcgaatgtgaagtcatactcttcgaacgttttcaccgccgggaaggctgccattcgggtatacatcgcctgtttacgttgatgacgtgccagtttttcttcatgaagcagatgctccaggaagtccatataactccattcctggtctactgcctgttgtgacagcgcaggcgctgcgcttataaggctttccagttgcaactgcccggcgagcgccatcagtcgttgatgttgcagttccatcatcacgccactcctctgcagaatgagtcgtagatggagagtggatgatgcagggggtgtttgtcgaagttcaccagattttcatcaagatgcacgtcatactcttttttctccggaggcagtgccagcatggactgctgctcttcgagccagcgatcgcagggacgggcctggattgtttcatgctttcgttggttagcgacatcgtgcagccagcgcagaccgtggcggttggctgtttcaacatcgacagtgatccccatcgggcgcaggcgagtcattagtgggatgtaaaaactgttacgggtgtactgcaccatccgttccaccttacctttagtctgtgccctgaaggggcgacacagtcggggagagaagcccatctccttgccgaactgccacagcgaaggatggaaccggtgctgaccggtctgatatgcgtcacgttgcagaaccacagttttcatattgtcatacaacacttcgcgcggcacaccaccaaagaagcggaacgcattacgatggcaggtctccagcgtgtcataacgcatattgtcagtgaattcgatgtacagcattcggctgtatccgagaacagcaacgaacacgtgaagcggtgagcgaccattacgcatagtgccccagtcaacctgcatctgtcgtccgggttcagtttcgaaccgaacggcaggctcctgctcctgaggaaccgagagagaacgaatgaatgccctgagaatggtcattccgccacgatatccctggtctctgatctcgcgagcgattaccgttgccgggattttgtaaggatgagcatcggcgatgcgttgacgaatataatcccggtattcatccaggagtgaagcaacagcaggtcgcggcgtatattttggcggctcagattttgcctgcaaataacgtttaacggtattgcgggagatccccagttctctggcaatcgcccggctactcattccctgcttgtgcaggattttaatttccataactgtctcaaaagtgaccataaactctcctgaatcaggagagcagattaccccctggatctgatttcaggcgttgggtgtggatcactattgcaccgttcgttacaacagaaaataaatgttgttaccttagaatcgtttaatcaaaaaatgaaatggcgttttgattgcgaggttcaaatgaatggagctgcgttcgtcagttcgatgatattggccgtaatatttactacaacaacagtacaggcgagccctgtggcataccaaaaagaagcaattactgaaaataacttacctgtattttatccacagttgaaacagcagatgaattatcaaagctcatggctggcagggaaatacacagatttcgctctatggcggagtgataccagaaaaattttaagacaggcactactcactccgaattcaaccatcacgttttccgcagagaagattgagcaacaagatcgcgggagctatatagctgaaaaaattgcccttaatattaccgatgaaagccgtgttctgggattgttattaacacctaaaacgaaagggccacacccagcgattgttttattacacgaccatggctcgaagtttgatattggtaaagaaaaaatgatccgtccttggggagatagtgcaaagctcgcttctgcacaggcttggtctgataaatttttcagcggaaagtttgttggcgatgagctggcaaaacgtggctatgtggtattttccattgattctattggttggggtgatagaggcccaatgagttatgagaggcaacaagctttagccagtaactttttcaatttgggccgctcgcttgccggtacgatggcatatgaagatatgcgaaccgtcgattttatgacaacgctcccgtcggttgaccgtaaacggatcggtgtgcttggtttttctatgggggcatatcgtgcgtggcagttggctgcgttgtccgatcaggtcgctgcgacagcagctatatcgtggtttggtaactataagggattaatgacgccggataataatgtgctgcgtgggcaatcttctttttatatgctccaccctggcatagcgaataagttagattttcctgatattgctagcttggcagcacccaggccaatgttactttttaatggtggaaaagataagctcttccctgcgcaagcagtggaacaagcttacgataaggttcatgctatttggcgttcacagaatgctgagccgcggttagtcacacgtagctggccaactcttgggcatgttttttatcaagagcaacaggatgtggtttttttgtggctagaccgttggctaaaatgactagccccagccagaagaccagggctttgtcagcaatctaggcccctaagggccttttaacctgtaaatattatcagtgagcgccgcctttagatgcccccaagccggtttgtgaacggacaaactgtgatttgaatagtaaccgttcctgtttgccggtttctgagttatccgtgattgagaagaaccaggtaccgacgaacgccgctatcattgaaaacaatgcagggtactcatacggatagattggcttttcatgaccaaggattgttacccagatcgtagggcctaaaatcatcaggatcactgccgttgataacccgagccacccaccgatcattgctccacgggttgtcagtttatcccaatacattgagatgataataattgggaagttacaactggccgcaatggagaatgccaacccgaccataaaggcaatattctgtttttcaaacaaaatccccaaaccaatagcgacgatacctaagatgattaccgtaattttggagactctcaattcatcgcgttcattggctttgcctttcttaatgacgctggcatagagatcatgagataccgccgatgcaccggctaatgtcaagccagccactacagccaaaatggttgcgaaggcaaccgctgagataaagcctaagaagaagctccccccgacagcattagccaaatggaccgcagccatattgttaccacccagtaatgcgccagccgcatctttaaatgtctggtttggaccgacgagtaagatcgcgccgaatccaataataaaggtcaatatgtagaagtagcctataaaacctgtggcatagaacacgcttttacgtgcttctttggcatcgcttacggtaaagaagcgcatcaggatatgaggtaagccagcagtgccaaacatgagggccaaaccaagagataatgctgatatcgggtcagataccaaccctcctgggctcatgatgctaaggcctttgggatgaactttaaccgcctcactgaataacgtattgaagttaaaattaactgatttcatgaccataatagccataaatgtggcaccagacagtagcatgaccgctttgattatctgtacccaagtggttgctaacataccgccgaacaggacgtacagcaccatcaggataccaaccaacacgacagcgacgtggtagttcaaaccaaataaaagttgaatgagtttacctgcccccaccatctgagcgatcaaatacagggcgacaacgactaacgaaccacaggctgataatgtgcgtatgggtctttgttgcaagcggtaagaggcaacatcagcgaaggtataacggcccaaattacgcaggcgttcagcaattaaaaatagaataatgggccagccgattaagaagccgatggagtaaattaaaccgtcgtaaccggaagcataaaccaaggctgaaataccgaggaatgatgctgcggacatataatccccagcgatggctaaaccattttgaaagccagtaattcgcccgccagccgtgtaataatcttgccgggagcgagtacgttttgatgcccaataggtgatatacaaggttccgccaacaaacagcaaaaacatgacgatcgcctgaatattgaggggttggcggtggacctcgccggtaagtgcttccgcctgtgctagcgcaggcaaaacgaataaagaaagtgcagaccaatggcggatcttcattgcttcacctcacgaataatttctgccgtcagacggtcaaattcgccattagcgcggataacataaatacctgtaagaataaaagaagtaacaattaatcccacgcccacaggaataccacgagtgacactcgagccggtatatatcggagtaccgagccattgtggttcgaaagcaataagaaaaatgaaagcgacatacatcgttaaggtgattaatgacaacagccaggcaaagcggctgcgttttttcaccaattcttggaaacgtggattatcttcaatctcttgataaatgctgtcattcatcagagtctctcctttgaggcatcaattaagtttgccgcctatataggcggcacaatttacgacggtgtctgcattgattgtttttcttctagtaatttttctaccacgcttggatcggcaagtgttgaggtatcgcccaagttgctggtatctcctgtcgcaattttgcgtaaaatacggcgcatgattttgcctgaacgggttttgggtaatgagtccgtccaatgcaaaatatcgggtgttgcaagtgggccaatctctttacgtacccagttgcgtacttcggtatataactctggagttggttcttcaccgtgatttagcgtgatataggcataaatagcctgtcctttaatattatgtggaacaccgacaacagccgcttcggcaattttcgggtgtgcaaccagtgcagattcaatttcagccgttcctaagcgatggcctgaaacgtttagtacgtcatcgactcgaccggttatccagtagtaaccgtcttcgtcacgacgtgcgccgtcgccactgaaatacatgcctttaaaggttgagaagtaggtttgctcgaaacggtcatgatcgccaaataatgttctggcttgccccggccatgagtcggttatgaccagattaccttctgccaccccttcctgaggattgcccaggttatctaccaacgcaggttgtactccaaagaatggacgagttgcggaaccggctttcaactcggtggcacccggcagaggggttatcatgaaaccaccggtttcagtctgccaccaggtatcgacaatcgggcatttactgttaccgatcttgttgtaataccattcccaggcttctgggttaatcggttcgccgaccgaccccataatacgcagtgagtcgcgtttggttccttcgatggctttgtcaccttcggccattaaggcccgaatcgctgtaggcgcggtgtatagaatattgactttatgtttatcaacaacctggctcaagcgattgacgccagggtagttaggcacgccttcaaacattagagtgatggccccacaagccagtggtccatataatagataactgtgcccggttacccagccaacgtctgcagtacaccagtagatatcgccagggtgataatcaaaaacatatttgaatgtcagtgcagcgtaaaccagataaccgcccgtcgtatgtacaacccctttaggtttaccggtagagccagaggtataaaggatgaacagcgggtcttctgcattcatctcttctggcgggcagtcagcggatgcctcttttatcaggtcatgccaccatacatcgcgcccatcttcccaatagctggcgttaccagtacgttggaagaccacaacatttttaatactggtgatagcggggtttttcagtgcttcatcaacattttttttcagtggaatagcacggcctgcacggataccttcatcggcagtaatcaccagtttagagtgagaatcgatgatacgcccggcaacggcatctggagaaaatccaccaaagataacggaatgaacagcgccaatgcgcgcgcaagccaacatcgccacggcagcttcaggcaccattggcatatagatggcaactacatcgccttttttgatgcctaaactttttaggacattagcaaactggcacacatcatggtgcagttgcttataagtgacggtttttgattgattagggtcatcaccttcccaaatgatggctgtttgatcaccacgctctgccaaatggcgatcaaggcaattcgccgcgaggttcaatgtaccgtcctcaaaccagcggatactcacatgaccggggtcaaaggaggtattttttaccgttttatagggtttaatccaatcaatgattttgccttgttcgccccagaattcatcagggttctgcactgattgttggtaataatgttggtatttttctggggtaattagagcatgctctgcaattgcagctggaataggatgtttatgtatttggctcatcgtcattctccttgaggttgttaataatatgtcaaataaaggttaattatagtatgggagagtgttttgtttcttttttgggcggcagatcacgtataaaagatgttgatttagtgaccttactcaaggtactgcgtggtgaatcgatatcttaatgatagtcggaggagggagtaccaaggcaataagtggacggaaaggtatttatccgcattttggcggttgatattgagtgcagagttaaaattgactaaagtaatttacatttattaaataaatgttgttttattaccattctataattaaatttattgcgttattacaaaatgagtaacaagaattaaaattaaaaaaatggagatataaaatcatatttttatatttattttattgtttgattttttgctcggtgtttttttaagatcatgtttgcttaagaaatttcttaagtgaaaggggcggcgatgatttttaaatttaacaaaataaaaacataatgaatcaaaaaataaaacataattggtatttatacagtaattttatttcacctattttttatccctcctggcgaagagactatttgcaatgagtgaattttactttttagataacaaatgtttactgaaagtgaaaaattcatatgaccgaatttatctatcatcacaatgtgggcatagtgtaaacaatacttgcagaagtgtatccagaaatgatactgatttataacgtggacggctggcgggaagctgaaccatatgttccatcaactatagcccgtatttaatgattaagtattttattctagatgcttagtttcttgcattttatggaatgctttgaggaattcttagggtatgaaaagtataaaaataagtctggcatggcaaatactcattgcactggtgttaggcattttggttggcgcagttttacataatcaaattgaatccagggaatggttagttagtaatattctgagtccagcgggcgatatatttatccgcttaattaaaatgattgttgtaccgattgttatttcaacgttaattgtcggtattgcgggggtcggtgatgcgaagaaacttggccggattggcctaaaaaccattatctactttgaagttatcaccacgattgccattattatcggtatcactctggcgaatgtattccagccgggggtgggtatagatatgtctgcgctaaccgtcgttgatatctctcagtatgaaaaaaccactgaacaggtgcaaagcggtagtcatagtctggttagcactatcttgtcgctgatcccggccaatgtctttgcctcaatggcgaaaggcgatatgttgccgattattttcttctcagtgttgtttggtttagggctgtcttcattgccaaaagaaaccaaagaaccactgttgaatgtgttcaaggctgtctctgaaagcatgttcaaagtcactcacatgattatgcgttatgcgcctatcggggtgtttggcttgatctcggtgactgtggctaactttggttttgcctcactaatccctctcgcgaagttagttattctggtttatgccgcgatcctgttctttgctttagttattctgggaacggtagcgagattatgtaagctgcggatctggatattgattcgtattttgaaagatgaactgattttggcgtattccactgccagttctgagacagtcttaccgcgtattattgagaaaatggaagcttatggcgcaccaaaagcgattaccagctttgtggttccaacgggttattcattcaacttagatggctcgacattatatcagagcattgcggctatcttcattgcacagttatacggaatcgaattgtctattgggcaagagattattttggttctgacattgatggtgacctcgaaagggattgctggtgtaccaggcgtctccttcgtcgtattactggcaacgttgggcagtgtgggtattccattggaaggtctggccttcattgccggtgttgaccgtattctggatatggcccgtaccgcgttgaatgtggtgggtaatgcattggcagtattggtgatcgccaaatgggaaaatcagtttgacgataaaaaagccaaggcttatgaaaaagcgttgtttgcagcagagcagacgccagctaatcaaagctaatacgctatgttcttagtgctacagccgcagtattagcgatagcctgatgagaatgtgacttagcgaatagtctctacccactccccgtcagcgtcagactgacggggagtttttatttgtcgccaacatttatttatcgccaacataagtaataagtagagagatcacatactggcattagacattcaagcctaatcggtatgaccagtgaataagttctgcgactttatgtacatccagttttttcatcatattcagccgatgtgtttcgacggttttttggctgatagaaagttgagcagcaataacccgattacacgatccctcggtgataagttttaatatctgccgctcgcggggtgtcagaaccgtaggagtattagcgggtccttgagtcagttttattaccatagaggcatcaagggcggggtcaatataacgtttacctattgcgacggtttgaatggctgccatcaggatttgctggggacttttcttcagcacataacctaaggctccactgttgaatgttctgctggcatagtgttcttcattgcgggcggttaacgtcaggatcttcatcgctggccaacggcgaagcaactgaatgataacatcaaggccatccataccgggtaatcctaaatccagaatgaccatgtcaggttcagtttggcggcacaagttatacacttcaagtccattatctgcttggcctacaatcaggtagcgcggataggcggccagcatattcttgatgccatgaataatgagttcatgatcgtcgacaatcaataatttagtattcattcgtcattctctttatttaaccataagggactggccctggctgatgataaacgtggattcgcaggtagtggggggctgtagcagcacatgaattatttcatcaagttgaatgatatcttgctgtgtcagcgtttcatgagtatcgagagcgtgttctaattgaatgaccgcatcttgtaattcaattagcccagcttgcccggcacagccttttatggtgtgaagcgtatgggataatacgggcaagttctcaatagcgtctttggcctgttgaattaatacttgcagtgattgataaagtttcagggacaacgcgctatccgcgagatccagtaatggctgaggctcggagagttgtggcgatagatcgaccccacgttcaagttggaattgtgcggtcagatctaacatttcagccaattggccgagggtgacaggcttggaaaggtagtggttcatccccgcctgactggttttgatttgctcatccgggctggcattggcgctcagggcggtgatcatgcagtggctatcaatgttcgccggatcatgacgccagcgtgctgtggtggccagcccgtccaggacaggcattcgaatatccattagcactaaatcgaaacggtgttggcggccaatcgccaatgcggttgtgccactgtctgccagcgtgacctgatgtcccagttgctgcaacatcattccggtaatatcgcgattcgtttcggagtcatcaaccagcagaatgtgcatttgccaaggttgcagcggaaggctctttagcacctcagtctcagcaccttgtagatattgcttcaggttggcgtataaccggccgggcaagtaacacaatgcgttatccacaaagtaccgtgatggctgattagctaattctggctggcaggtcatgccccaggctgataattgggcgtgtaagcgctgtggtgcgaatagctcgccatgaaaaggcatgggtggggtgattgcattgaaggggaggcataatgaaaaacagctaccttgacccggttcactgaatactgtcaggtgccctcccatcattttggccagattatctgcgatagccagccccaaacccgttccttgttcatggtcactggtctgcataaaaggttggaatattgtttgttggtgttgcacgtcaataccacaaccggtgtcctcaacggtaaaacaaagcgtttggttttgacgcctgaccctgagttgaatacggccctgtggtgtgaatttaacggcattacctaataaattaaccagaatctgtcttaagcgcagtgtatccagctcaagttccagcgggatatcggcactgataaacgtggacagcgctaatgacttactcagtgcctggctatgaatggttaacatcgcctgatccagtaaaggcagtagggccgttttctccagcgacagtgtcatttgccctgattcaatacgtgaaaaatctaacaggttgttaatgatcgcgagcagtgacaacgaacattggtgagccgtttccgctaacctcatttggccagcatccagtggtgtattttgtaataattcaaccgcccccaacgccccgttgagcggtgtacggatttcatggcttatcgtggtcagatggtcgcttttacggcggttagcctgctcagcagctcgtttggcttttgccagagccagagtacgctccttcactttcatttctaaggtgtcatattgttcgttcaacgtatccagtaagttattgtaagcgcgggcaatatgccctaattcatctattcggtttatgggaagtcggggttccattgcctgtggcccggtagcgccaatgatattgatgaaattccacaaagggatcgccagataatatcgcagcagcagtgacagcactgacgtgagtaacagcaaaataaccagagcgaaagggagttgatataaggcgggtttcagtgcctcccaggcaaagcctattcgtggataaataactaattgctgccaacccggccctttcaattgggtgcgtaataccaaatagtcgggagtttgctgccagccatcgtgtaatttactgtttttgagttggttaagaatttcatgtagttgatttgatgatgttgcttgctgggaaataggtaataattcaccattcttatccaacaataaattaatgtctctttgctcgacagggtgattataggcgatgagatcattcagttttaaggcgaagccagccaaggtgcccactttatcacacaccgcgacagaaacatgccagccaccttgaggcgtataggtgggggctccccaatagatattattgtgagtagggaatttggggagcaaaagtaaatctttgcgccgttgatttaggtaatcactcgatgatttttggggtggaaataacacaatcccctctttttgtttgataataaaactgtcgagataataagtttgtccggcggtgccatacgcttgaattatccacagatcatttttatgttggttaatattacagctgtccagattaaaaggaatatagcagctatcataatgttttatcgatatttcaggcaacggtgaggtgctctggaggctttctcgtcggcttattaacgaggctgcatcacgttcagctccttcaaactggtgattacttaagtctgcccgcatcgatgccatatgtgttaactcattgattaatatttgacgtgtattttcatatgaaaagaatgctgttgttgcgattaatattaaccaaataacggttagtgtgacgcccagtaataatgtcaatcgagtgacaagtgatgatgctttgcccataaagtcacctgatttttttcttcagtacgccatagctgataagggatatcaagaattacactgatataattactcatcgttatagattcatttagttctatgaatatgagcggtaatcaggtcataaccttattgtggttttcagattgtataaggataattattcaatatattgatagtcggtttacgccaaaaaccgtatttaaatttaagaaattataagtggatgtcgctaatctatatcatgagaaaaataacgggtctgatattacttttttttgccacattgttgccttatgggaaattttcttatggaaaagcgattccttggcaaggcgagcctttttttatttatagccgaggcatgacagtttctgaattattaaaagatttggggatgaattacggtattcctgtggtgatcagttcggaaataaacgagcactttactggaaagattagggataagacacctgaaaaaatcctatcggagttggctgggcgatataatataacgtggtattacgatggtgaaacactctatttttacccagttcaatcaatcaagcgggagtttatatcccccgatggtctggctgccaatacgttagttaaatatctccagcgcggtgacgtgctggcggggaaaaactgtgccataaaagcgatcccccaccttgatacccttgaggtcaagggagtgcctatctgcatcgaacgcgtaaagtcagtaagcaaaatgctttctgagcaagttcgtcaccaaaaccaaaataaagaaacagtgaaagttttcccgctgaaatatgcttcagcagcggattcagattatcagtaccgagatcaaaacgtcagattaccggggttggtcagtgtgttacgtgagttgaaccaagggaataatttgcctttggcgggcggtaaccaaccagatggaaatcaagcaagctcaccggtgttttcggctgatcctcggcaaaatgccgtcattattcgcgatcgccaggctaatatgccgatttatcgcagcttgattacccaactggatcagcggccaattcagatagaaatttctgtcactattattgatgttgatgcgggagatatcagccaactgggtgttgattggtctgcatctgcttctattggtggaacgggggtctcatttaatagcaccttcgccaagaataatgctgaaggcttttctaccgtgattggtgatacggggaactttatggttcgtctgaatgcgttacaaaaaaattcacgagccagaattttatctcaaccttcagtggtgaccctgaacaatattcaggcggtactggataaaaacgtgacgttttataccaagctgcaaggtgagaaagtggccaaacttgaatctgtcacttcagggtcattactgcgagtgacgccaagaatgatcgagaccgaaggggtacaagaggttttacttaatctcaatattcaggatggtcagcagcaagcttctaccaatagtaatgagccattacccgaaatacgaaactcagatatttcgacgcaggccacgctacaggttggacaaagtttactcttgggcggatttattcaggacacgcagattgagtcacaaaataaaattcctttactgggcgatattccgctattaggtgggttgttccgtagtacagataaacaatctcacagcgtggtcagactcttcctgatcaaggccgttccggttaatgcaggggaataacatgaccaccgtattcaagcttcgcctgttaaatggtgatctcaatggtcgtgagctgatattaccggaaggtgaatttacactgggggagcaggggtgtgatgttctgctgcctttatctgacggcaatatagtgacgctatgtgttaatgaatatcaggtaatgatacaggtggcggaggaggtttggattaatggtgcacagcacgatttacacactccccttccactgttgcaatctattgaaattgccggattggtattcgttctgggtgaacaaacggatattttgagtggaattaaagtcactcaccgtgcgaggttccctttattggtatggctagctattgcgatatgtgtccccttatcactgctgtttgtttttttattttggttaaccactcagcctgagacattacgtgcttcgattcctgcggatgtcccgacgcaattagccgaacgcctgcgcgaacccgctttacagggaataaagggaacctggctagcggatgggagtgtcacattaagtgggcattgtgcctcgtcctcaatgatggaaccactgcaacattttttactgcgtaaccatatcgcctttcgtaaccaattggtgtgtgatgatcgcttaatcgcttccgttagcgatctattacatcagcatggttaccacgatattgaggtgcgcatcggtgatgaaccgggaaatattgtgatttatggtgccgttcaaatgggtgatcagtggttaaccgtgcaggacacgctggcggcggtttcagggttgaaaggttggctggtggtcaatgctcattcagggcaaatacaacaactggtggagcgcttgagagcggcaggcttattaggattcttaagcatgacggaaagtaataaagagttggccatcagtggtgtgctgtcatctgaacagcagcagcagttaaaggagacattggccgctttatctcagcagcaacccggttttccgtcagtcaggtatcagaatattccggcgtcagaccgaacggatcaatttcttccggcaaaggtcgtgagctatggaggaaatacccagtcggcatttgtgcggttagccaatggtgggcgtttgcagcaagggagcgtgttggcaaatggctataaagtggtttttattggggaacagggactgacgttattaaaagcaaataatttagtacatatccccatggatttctaaggttcaggagtaacggaaatgcagcatattactgtgctggaggaggatattaaacatgaccctacagcgatccaacaaagaaaagagatattggcgagaggaagacggttaattacctgtcagttgtctttgctgcaaacaccagagaattatcagtctcttaataacatgatgttggccttgcaacgtgcagaagaaataatagaaatactgacgttgcgctatgggaataaagaataaagtgatgtttactgtctgattattcagacttcaggtgaataccggatacgcattggcagtattattggtcaaactgcataagattaattgttccctaaggaatatcatgaagtcaatacagtttattttatttcggcaagagggcgtattacgcagtgatggcgagcgctatgttatacctgcgggaaaattagtgattgccgatgagcaggccagtgcctctgcgtttgcaaacagtgccatcacctctatattatgttacccaatagatctttttccgatatatcaggatttagccagaagaacattaccgttgaataaaggccatcttcctcatgcggtaaatgataaatataaagtgttgccagcgaatgttgaaattatacaagctgctgaagaattaattaatatagagcgtgttgcctctctgcgatttctttatctttattgtttaggtatcgataacgtttatttttccaagctgttggactccattgtgggtacgaataacgaactacttgagtttttcgaaaagaatcggctcaacccatggagcgtttcacgctatgccaatgaattgggtatttcgacccggaaattgaatttcctgttttatgagaaattcggcatgtcggcgaaacagtggttactggatcagcgtttgaaaaagggctgtgagctattactttcgacccgcttacgggtggctgatattgccatggagtgtggttttagtaatcacgcgcatttctcagatagctttcgtcggcgctttcaacaatgcccatcgcatatgcgttcacttattgaataggagagtttgatgcagataagtagcccaatgggccaattgacaaacgatattcagcaggccagacaggcgtatcagaaccaaatggcggcagtgaatatcaatgaacccgaacagatgttgaagtcgcaattcaccatgaatcagtattcggcttttctcgatttaaaaagtatcgagatgaaaatgatcaacgatataagaaacagaatcctgtcccgcatatgagcttactttcagcggattgccgtcagttggtggtcgaggccgcactggcgggtgtcaatcacagcttgctggccgaagcccacgatatcgtcaatgcgttgcccttattaataccagatcctcaggtacgtttggtttgtgaggcgatgttgcggttcgggctgggcgataaggtccaggcgcgggctttgctggcgacatcgggggaagaagacgcacagattctgctgggtttactgcaataaggtgtagttcaggggctgacaaagtcaaatgacgggaaacgtgctgttagggtaaccctaagacagaattaattttttattaataggcgatgatcagatgaatatgagtagtgctcaggccgttgctggcttgtttcaggccacagagccgccagtgggtaacacacagcaagtggcaaagtttacccagttaatggcgcagccagcgtcaacggaattaatgatgacaccagaatcattgctgatgcagcaggctgaatggatgcacgcttcactggcgatagatttaaccgccaaagtggccggtgtgatggggcagaacatcaataaattggtcaacatgcaatgaaatctctgcggcagatgttagcgatagtcctaatgacattatccctttccggttgtgatatggagctgtatagcgggctgtctgagggggaggccaatcaaatgctggcattgctgatgctgcaccaaattaacgccgaaaaacagatcgaaaagagcgggatggtggggctaacggtcgataagcggcaatttattaatgccgttgagttgctacgacagaatggtttcccccgacagcgttttatcacggtggatgagctgtttcctgctaaccagttagtgacctctcccacgcaagagcaggccaagatggtttttctgaaagaacagcagttggaaaacatgttgagccatatggatggggtgattcatgccgatgtcacggtggcaatgcctatgtcggttgacgggaaaaacccgcttccgcataccgcctcggtgtttatcaagtattcgccggaagtcaatttacaaagctatcagtcgcaaatcaaagggttggtccgcgatgcggttcccggtattgattacgccaagataagcgtagtgatgcagcctgcgaactaccgtttcagtgcctcagaggcagagcaacaacaggggccacaaaccacggtgcaatggctattacgccatgtaggaatggtgcagaacatggtgggagtggcgtttatctcacttattgtattgatgtttgtaggctggttttattctcggcgtcggtaaagggcgggcggcgtcgataaagggcgggcggcgtcggtaaagggcaggcgacgcaaataacgagtgggcgtcagcaaaacggtgtctgtcaataaaacggtatccgacagtaaatcagacatgtcagtacggtcatacatgtcagtaaatcatcgataaaaaagcgaatacccaacgtaaccagggagggcatgatggcattttcaccgtccatcgacgtgcaatatttacaccagctagcttggcgaccagcacagtttgcccacccattatggttggcagcggtgggcgttaacccagaaaactacggctatgggcgcagccgggcattggacagtgcgttgaatggcatgttgattcaacggcgaaaatttccgcaacaacgcctgcctgcggtattaaaccctcggcaacagcgccaaattgcacagcgccaacgcttaccggccctgtgtctggcgctcggggttgtcagtttgcagtgcgatgattatttgcgtctccgccgctaccggcaggtgctgtctccgctgctaaatgacgatgatattcaacaaattatagggatgggatatcgcggtcagtggcaagccagtctaagcccacagcagctacccgatgtggcattacgcctggggcaaagccttgcctgccaagttcgcagtaacaatattatttggcaggcggtctccatcttgctcccccctaacccccgtgcgctatgcctgtcacgttctatgcaggcgcaaacagaagcctggttaagccggttggagcgtttattgtgaacccctttcacctcgatattgaaaagtacggttatccattgccgcctggcgtagttattccggcggcttatctggcagaggccatgcacagccaggatctcttggcacaggccaacgcgcaagcggcagagatactgcaagcggcggagcaggcgcgtgtgttgttgctcgatcaagcggcggagcaggctgatgcactgatcggtcaggcgcgtgtgcagatggaaaccgcactgctcgcacagcatgttcgctggctggtgggcgcggagcaattggagtcgttactgataacccaagttcgccaccgtattttagccgccatcacgtcagtggtaacgacctggagcggtgaacaaccgatgagccagattttgatccagcggctgggggatcaagcagagaaaatggcacagcaaggcgaattaacattacgggttcatccacagcatctgccagcggtgaccaccgcattgggagagcgtctgcgttgtgtagggaatacggagatggccgcagatcaggcgcaactcagctctccaatgctgcaacttacgctttctctccaccaccatttatctcaactggttctgtggctacagcagtcgccagatcttttcgacgaagagaatgtttatgagtaagtcagcactggtgcggggtttgacgatgatcaccgcgcggcaggatatttttttagcggtcatgttgctggtggcggtctttatgatgatcctgccactgcctacgacgatggtggatttactgatcgccatcaatcttgccttctccgtcattctcttaatgatctcgatctatctgcgcgatcctttggagttctccgtcttcccgtcattactgttgatcaccaccctttatcgattggcactgacgatcagcaccacgcgactggtgctgttgcaacatgatgccggtgagattgtcgaggcattcggtcagtttgtcgtgggcggtaatctggccgtcgggatgatcatttttaccattatcacggtggtccaatttatcgtgattaccaaaggttcagagcgggttgctgaggtcagtgcgcgcttctcacttgatggtatgccgggtaagcagatgagcatcgacggcgacatgcgtgcgggtgcgatcgattcggtcgaagctaaacggctacgggagcgggtacaaaaagagagccgcttatttggtgctatggacggtgccatgaagtttgttaaaggggatgccatcgctgggatcattgtcattctggtcaatatcattggcggtatcactattggtgtgatgcaacacaagatgtccgcggaagaggcgatgaatacctacgcggtattatcgataggcgatggattgtgcgcccaaatcccttcattactgatctcgattaccgccgggattattgttacccgggttcctggcagcaacaaacagagtctggcgaatgagttggcggtgcaggtggggcgtcaaccggatgcgctgtggttagctgccgctattctgacggtgttcgccctgttacccggcttcccgttcctgatctttatcactttggcggccgcggttgcggctccggcttttttactttatcggaagaaccggcggatatcgcaggatggtcgcgcaaatggaggcggtgaagagggggcggccacggggcagcgtatgacgcctggtgccgtaccgctgatgctgcactgtgcatcaaatttacatcacccgcatttagggcgcgatattgatggcctacgctggcgctggtttgagcatctcggtgtgccattgcctgaggtggagatccgctgtgatcctacattggcagaaaataccttatcggtgcaggtgtatcaggagcgggtgctggaggttgtgttaccgcccgacagcttgttactgacacggccttgctcatcgttagtaacgaacaatcaggcattgggcgcgaagatggggtcatttgattggctggatgctaaacaggctatgcaagccagaaccttgggtatcccttacgtggaggggcatcagcggatcatcacctgtctgaccagggtgtttgaacggtacaccgccgaatttatcggcgtacaggagactcgctacctgatggatgccatggaagggcgctatggtgagttagtgaaagagctacaacggcagatacccgtcggtaaagtggctgaaatattacaacggctggttgaggaaaatatttccattcgcgatttacggactattttcggcgcgttggtggtttgggcaccgaaagaaaaagatatcgtgatgctcaccgaatatgtccgtatcgccttgcgccgtcatttgtgccgtcgctttagtcacaataaaacctggatatcagtattacgcctcggtgatggggtggagcatctgatccgcgactctatccgccagacatcatcaggcacttactccgcactggaggagaggcaatccctcttgatcctcaacaaaataaaaaacgcatttgctgaaaaccaggatgcggtattgcttaccaccctcgatgttcgtcgctttgtccgcaaaattattgagcgggatctcttcgtgctaccggtactttcctggcaggaactgggcgatgaaatgaatctcaaggtggcgggcaccattgaactgattggcgatgaacttgatgaaactgcctgatatcgcgcggttaaccccccgcctgcaacaacaactcacgcgaccgtcggcaccaccggagggcttgcgttaccgtgggccgattgtggagattgggccgaccttgttacgagccagcctacccaatgtggcgcagggtgaattatgccgcattgaaccgcaagggatgttagctgaagtggtatcgattgagcaggaaatggccttgttatccccctttgcctcttcagatggcctgcgttgtgggcaatgggtgacgccacttggacacatgcaccgggtacaggtgggggctgatttggccgggcggatcttggatggcctaggtgctccgatagacggcggccccccgctgacggggcagtggcgtgaactggattgccccccgcctagcccattaacccgccagccggtagagcaaatgctgaccaccgggatccgcgcgattgatgggatattgagctgtggcgagggccagcgtattggtatttttgccgccgctggcgttgggaaaagtactttattgagcatgttatgtgctgatagtgcggccgatgtgatggtgctagcactgattggtgagcgtgggcgggaggtgcgcgaatttcttgaacaggtgctgactccggaggcgcgtgcgcgcaccgtggtggtggtggcgacctctgaccggccagcattggagcggttgaaggggctgtctactgccaccacggtggcggagtattttcgcgaacgtggattgaaggtgttgttactggcggattcactgacccgctatgcccgtgccgcccgtgaaattggtctggcggcaggtgagccaccggctgctggcagtttccccccaagtgtttttgccaacttaccccgtctgttagagcgaacgggtaacagtgatcgtggcagcattacggctttttataccgtgctggtggagggagatgacatgaatgaaccggtggccgatgaagtgcgttcgctgttggatgggcacatcgttttatcacgacggttggccggtgctgggcattatccggcgattgatattgccgccagcgtcagccgtatcatgccgcaaatcgtcagtgccgggcagttggcgatggcacaaaaactacggcgaatgctggcctgttatcaggagatcgagctgttggtgcagattggtgaatatcaggcaggagaagacctacaggctgatgaagccttacaacgctatccggcaatatgcgcctttttacaacaagaccacagcctaacgcgtgacccagatactgctcatcttgataccactctggaacacctggcgcaggttgtcggttgaatcactcgcaacagcggacgctacaacggctattggcgctacggcagcggcaggaacggcggttgcgccagcaactgggacaactgcggcgtgagcagcagcaacaggagcagcaactggagaatggccgtcgccggcatcaacaactctgccagcaactacaacagcttgcgcagtggtgcggcatgctgaccccgcgagaggcggatgaacaaaaagtattacggcaggcggtgtatcaggcggaacggcaggcgaaaaaacagctaaacgcatgggtggcgcaagggcggcaacaggtcagtgccattgagcgacaacaagcgcggttacggcgtaatcagcgtgaacaggaaaaattacggatgctgacagaagatgagtcgaatcgatattgaaggcgcgttaccgccactaagagaacaaggttattcaaaagagcgatcaacacattgggatcatgagaggcaacgtcagcagtttgctcgctgtttctcctctcccttaccccgaatacaaaacatagcgtgtaccgttgctgggtatgacgataacggcctgatggagacgcattatcgtatcgtcagtgggccgctatgtgggacaaaagtcagtgtcagcatgacggctcacgggttacgtatcgtgctcagtcatacagagagcaaactgattgaacgcttacagcgcatacaaaaccgctggcagcggcaactgcatcagttagggttcccgtgtttactggaggtcacctgtgctgacgaatctgacgcctgagttacgcgcccttagcaccttgatcgggagtggccggcagacagcaggggtgtcggtggccttgacggagattgacggtgagggcgtttatctgccactgcattatggcggccaagagtgtgggttgtggttatcacaatcctgttggcagcactggctgaacacgacgttggcaaccgataacccccagttgttggccgcagagttagtgatcgccatggctaattgggccgtcaccccattgttagcgccgtttaccgatctggtggtattggccgagtcaccacagaagaggtcactaccaaagcagtgggcggtgacggtggctttcgagctggagggacagccgattatcggtgtgttacaggattggccgcaggcggcattagccgacaccttgtctcattggccgcacgaagcggtcaccgctcctgatttgctttggcaatctggattggtggcgggttggtgccacttatcattgcgtcaattacggcagttagggccgggtgagggtttacgcctctctatggcggcggaattggataaagaagcgtgctgggtatggcatcacgcatcgccacaaatttatatcaagctagagggtgggaacagaatgacaattcaacagattaatgaagcgagtgacccgctggcctgcggcagtcgcgctgaatcaccgcctctggcggcggtacaacttgaggatttaccgcaaacgctggtgatggaaattggccgtttgaccttgcctctgggggagataaaacaactcgcggttggtcagacgctggcgtgccaaacccactgttatggcgaggtgaatatctgcctgaatgggcaatccgttggccgtggcagtttactccggtgcgatgaaaaactggtggtcagaattgcacaatggggattacaaaacggcgaaaatatcatggaatgacaagattgaggtgaacacccgatacccctgaaaggggcgggggacaagactgtccatcttgtttttatgcgaaacagcttactttttatcttatctgaaacagatgacttatatgaaacagatcacatggaattactgaattcatcctatcaattgatcgccctgcttttcatgctgtccgtgttgcctttactggtggtcatggggaccgcattccttaagctatccgtggttttttcgttgttacgcaatgcgctgggtgttcaacaagtgccaccgaatattgccatttacgggctggcgctggtgctgactatttttatcatggcaccggttggtttagatgttcaggcgcgcttgcaaaatgaagagctgtccaatgacatcggcgcattagcgcaccaaattgatcaaaatgcgctggtgccctaccgcgattttttacagcgcaataccgatattgagcaagtcactttttttaacgacattgtgcagaataagtggcctgagcgttaccgcgatagcgtcaaacccgattcactgctgatattaatgcccgcctttaccctcagtcagcttaatgaagcgtttaaaatcggcctgttactttttttaccgtttgtcgccatcgatttaattgtatccaacattttgctggcgatgggcatgatgatggtgtcacccatgaccctgtcattgccgtttaaactgttggttttcgtcctggtggatggctggtcattggttctcggacagcttgtaggttcctatttatgaacaaccatatgagtagctaccacgagaatgccatcattgttcatctggccactgagttgttatggctggttttactcctctctctgcccgtagtcgtggtggcttcaacggtcgggttggtgattagcctggtacaagccctgacccaaatacaggatcaaaccctgcaatttttgattaagttgttggcggtatcagccacattactgatgacctaccattggatgggggcgacattgctgaattatacccagcagagttttttgcagataaccagtatgcggccctgagatgactgacgtcctccccggtctgaccgcactcgcattagccatgatgcggccctacggtatcttactgatattaccgctgtttaccgcccgcagtttggggagcagcttattgcgtaatggcttgattgttgccatcgcgctgccggtcacgccgctatttttatccgcacccatcatcaccaatagtagcccggtcacttggattggggtgttatgcacggagctactcattggggtggtgatggggtttgtcgccgcattgcctttctgggctatgaatatggcgggtttcctgatcgataccttacgcggggcaacgatgtccacgttgtttaaccccggtatgggcgtcgaatcctccctttttggtgtgctgtttacccaaatattaacggtactgttcctgatttctggcggttttaatcaggtgttggcggcgttgtacggctcgtacgatagcttacccatcggccagggtatccagcctgctgcagatctattgctctttctgcaaactgagtggcagatgatgttcgagctttgcttgtgctttgccctaccggcactgctggtcatggtgttggctgatctctctttaggattaattaaccgctcggcccggcaactgaatgtcttttttctggcgatgcccattaaaagcgcactggcgctttttctcttactgatcagcctaccttatggcctgcatcactacctgtcccgtatgagcgatactgaacagaagattggtacgttgatcccgttgattaaaggggggaatgatgtccactgaaaagaatgaaaaacccacgcccaagcgccttaaggaagccaaagaaaaagggcaggtagtcaaaagtgttgagataacctccggcgtacagttggtggcgctggttatctactttttactgacaggatatagcttggtcgagcaggctaaagcccttatccgcagttcaatcatacaattacagcaaccacttactctggctttagcccgtatcggtgccgagtgcatgacggtattgatgcatatcgtggtggtcttgggcggggcgctgatcgtggtcaccattattgccggtattgctcaggttgggccgttgttggcgaccaaagcggtgtcgtttaaaggtgagcgaattaaccccattcaaaatgctaaacaacttttctcattgcgcagcgtgtttgagctgatgaaatcattattgaaagtgggggtgctaacgctgatttttggttacttattgatgcagtatgcgccctcttttggttatttgacccactgtggcagtcgctgtgctctcccggtattctcgacattaatggggtggttattaggttcactgattgcctgctatctggttttttcactgatggattatgcttttcagcgctacaccatcatgaaacaactgaaaatgtcccatgatgaggtcaagcgggagcataaagacagtaatggggatccgcacattaagcagaagcggcggcagctacagcatgaagtacaaagcggtagttttgccactaacgtgcgccgttccaccgcggtagtccgtaacccgacacattttgccgtttgtctgatttatcacccagaagagacgccgctaccgatagtgattgaaaaaggtcatgacgagcaggctgcattgattgtgagcctcgcagagcagagcggtatccctgtggtagaaaacattgcgctggcgcgtgcattacaccgtgatgttgcttgtggtgacaccatcccagaacaattcttcgagccagttgctgcgctcttacgtatggcactggagttggattatcagccatcaagtgatgatccaccgcgctagctgacccccgatataccccgtgattcaatgatattggctatttcaacccaatatttgaataatatctaaattatgtaatatcgatctttattatgtgaataataggcttattatataagcctcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcaataggcttattatataagcctactttccctgttaccttttatcccttgatattattaatattatcggtaacagcttgcttttggaggtgccggtatgagctggcccgagtttaaatctcaatatctggtgcgcttttgggcacctttacctgcggttattgctgccggtatcttagcgacctattactttggtttgactggcacgttctgggcggtcactggtgagtttactcgctgggggggccatattatgcaattgtttggtgcacagccacaggagtggggctattttaaagtgatcggtctggaaggaacgccactggatcgtatcgatggcatgatgattatcggtatgttcgccggttgtatcgctgcggcactctgggctaacaatattaagttacgtaagccgcaacacactatccgcattgcacaggcgctggtggggggcataattgctggttttggtgcccgtctggcgatggggtgcaatttagccgccttctttaccggcattccgcaattttcactgcacgcgtggttttttgcactagcgacggcagcgggctcttactttggggccaaatttacgctgctccccctgttccgcattccgattaaactacaaaaagtgactgccgcctcaccactgacgcagcacccagccagagcggcacgccgtttccgtctgggaatggtggtcttggttctggcgcttggctggtccctgattgagttgttccgtcagcctaaattggggattgccatgctgtgcgggattggctttgggctcctgattgaacgtgctcagatttgctttacctccgcttttcgtgacttgtggataaccgggcgcacccatatggctaaggccattattctaggaatggcggtcagtactctcggcattttcagctacgtccagctgggcgtcgaacctaaaattctgtgggctgggccaaatgcggtaataggtggtttactgtttggttttggtatcgtgctggcgggtggctgtgaaaccggttggatgtaccgtgcggtggaagggcaaattcattattggtgggtgggattgggcaatattatcggcgcaactctcttggcctactactgggacgatttcgcccctgcgttggcgaccaattacgataaagttaacctgttggagacgttcggaccgatgggcgggttgctggtgacttacctaatgttggcactagcatttgccgccatgctgtggtgggagaagcgtttctttcgcaaacaaaaagcgacaacctcggccctgattaaggaatccttatgagccattctccatccgtagaaacaccccaactggcagcgcctattgtgcctgattatcgcctcgatatggtgggcgagccgtgcccgtatcctgcggttgcaacgctggaggccatgccacaactgaagccgggcgaaattctggaggtgatcagcgactgcccgcagtcgatcaataatattccgctggatgcccgcaattacggctataccgtgctggatattcagcaggatgggccaactgttcgctatttgattcagcgctgatattatccggggccgcgctttgtctggcgcggacacaggctccttccaactgcttgcagggtgagtgtctgtcatcgtcaggataatgagatttgataatctgctctccatttatcccatggcacgtccattgacagttcatccaacataaaatcaataaaacttcttatttttggatcgttatatttgctagggtaatataaagcatataggccatattctttatctttagcattataatccagtaaaataggcactaatttacctgaggttatatagtcgcccagcatataagtaggtagacagacaatgccctgatgatgcagcgcagcatgtaataaccccaggctgctgttggcctgcacggtattttttattttcaaggggacgctctcaccctctgtacttttatataaccaggcatcggaaacgttagggtttaccaggcaatcatgttgctcaagatcttcgatagtggctggaacaccgcgtttcattagatattctttactgccacaataaacccagttaatggtacaaatccttcgtatagcaaaattaggcgggggaattgaggtgatacgcaaggcaatatcaaaatgttcttcatttaaattcactaactgatcatttaaatctaccgataaacagacatcgctgttagtttctttatattgactaaatagatgcattaaatgacagacaccaaaagcgatagagcaggtaatcttgagctgcccctgtgggtggttataaaaactatgcgtattaaccagtgtttcatccagatccaaaaggagttggcgcgcctgatgaaacaagtaatcgccagcatcggttaaaacgatgctgcgagtggttctttttaatagtaccacaccgagcttctcctctaattgagccagactacggctagtggaagacggtgttatatttaatttatgtgcagcaatggataggctgttgcattcaacaattttgataaaattctctaaatgcttataaatggcatgattatttatttttgcgctaaatgcaaaagtgttttcatctattgacatcatacacctatattattaatagtttatttagacaatactacacctgttagtttttaaaatgaaatattgcttttttgtagatagtcaaacggttttatttttcgattttacgccaggaaggtagttaacttaatgtaattaaagtaaaaataaaataagagggtgaagtatgtctgaaatctcgtcttcaaaatctgaattaaaaaagctctataaatcggttccctttacacagtatgatgtcggttgggtcatattatgtatcgggatggctatcggatcaggtatcgtatttatgcctgtacaggttggtattaaggggatttgggtctttattgctgcggttattatttcgtatcctgcaatttatttactgcagaatctctatctgcgtacactttctgaatctgataactgtactgattataccagtgtcattacgcaatatttaggtaagaactggggggtaggtctcggtattgcttattttttaatgttattgcacgggatgttttcttattccctggccgtcacctttgatagtgcctcttacatcaaaacatttggattaactgaaggcttattatcagattcaatatggtacgggttaattatcttgacagttttggttgccattgctgcacaaggtgaaaaaattctatttaaagtttcgggacccatggtttgtgtgaagtttggcatcattgtggtgttgggtgttgtaatggttccttattgggattttaacaatatctccgcttttcctgaactcttctcctttttacgcgatgtcctgttaacactaccgttcacattattctctatcttatttgttcaaattcttagcccaatgaatattgcttatcgtaaagtggaaagcgataaaagaattgccacctaccgggccatcagagcaaaccgtgttgcttatatcattttggctgttgcagtgctgttctttgccttctcttttactttctcgattagccatgagcaggctgtctcggcgtttgaacaaaatatctctgccctggcgattgccgctcaggttattcccggttcgattgtccgtatcatgactgcattattaaatatttttgctatcttgacggcgttcttggggatctatttaggatttcaggaggcgattaaaggtattgtcgttaatattatcagtcgctttatccctgaagagaatattaatcagaaagtgctacacatcggggtctgtgtcggtgtgatattaacgttatggctatgggtctcaacccggttctctattcttttcttcttacaacttggcggcccgttattcggggtggtctcttgtttaattccttgctacctggtttataaagttcctgttttacataaattaaaagggccaactatttggtttatcagctttttcggtattcttctttgtctttccccattctttaaattctttgagtaacgtggctaaaaacaggaatgaatctggtttaataagaggtaggtaatgaataaaaaagatatttctagttttggtattagtactcaaataacacaactgggtagaaatccacaagagcagacgggttttgttaatacaccgatctatcgggggtccacggttatttttaatacggtcgatgacattgtcaataatcgtgctgtttttaactatgggacagcaggtactcccactattgctaatctagagagtgcgtggaccgcactggctggggctgcaggaaccgtgatttccccttctggcttgggggtgatcgcgttagcattgttaacaacgctaaaagcgggtgatcacttgttgatgccagatagtgtgtataaaccgacaaggttactctgtgcgggtctgatcgctcggatgggggttgaaacaacatattatgacccattgatcggtgctgaaattgaaacattaatgaagccgaatacatcgacgttatttttggagtctcctggctcacaaagcttcgaaattcaggatattccgatgatgacggcaatcactaaaaggcgagggattgcgacaattattgataatacttgggcttcaccgctattttttgccgcccataaacatggctgtgatttatcacttgaggcgggtaccaaatatttgggcgggcactctgacctattaatggggctggtgtcggcgaacgaacaatggtggcctaaattaagggagacttatgactctatggccatgctaccgggggctgaggactgtttcttagcattacgtggcttaaggaccctacatctacgaataaaagaggcagaaaagcgcggacttgaaatggcgcaatggctgaaagagcggccagaagtgttgcgtgttttacatccggcctttcctgattgccctggacatgagttttggaaacgtgattttaccgggtcatcaggtctattctctattgtattaaagcccgaatttactcaaaaagggttggcggagatgttggacaatatgtctatctttgctatgggtttctcttgggggggatatgagagcctggtgatcccttttgattgctcggaataccgcacggtgacgaaatggaacccaggtggattaaccatccgcttacaaatcggtcttgaggatatggaggatctcaaggaggacttggcgcaaggttttattcggttagcatcaaatagttaattatcgcggggcggatagtttttatcggcatttccgccccttgcttcagttttgcgggtgatctgtttagttgaccatctgcttagttggtgctttggaaccgccataggctgttttttagcatagcggtaccggtaaaattattgccgcagataaatctgtggcagggcgctttctgggtgacgcgaaacgcccaaatctgcctgataccattgggtcagtgtttcggcattgagtacctcttccggcgtaccacaagccacgagttttccctgcgccagcagcataatacgatcagcgtatagcgccgccagatttaaatcatgtaatacacagcagacagcgagtggctcctggcgggtcagttgacgcagcaggcgtagcgtgtgctgttggtgatataaatccaaggcggatgtgggttcatcgaggaatagccagcgtggtgttggctgtggttgccaaagctgcgccaaaacgcgcgccagttgtactcgctgttgttcgccaccggataaaacgcgatagtcgcgctgtgccagtgccagacagtccgtttgcgccattacctgttgcaatgcttgtcgatcctgtgagccaccgtaaggtgcgcgacccatctgaatcacttcactgacgctaaaaggaaaagccagttcgctgtattggcgcatcactgcacgggtacgggccagtgctttcggttgccagctattaaggttttgccccagcaggtgacactcgccgtgggaaggggaaagatagccagtcagtaaacgtaacagggttgatttccctgcgccatttgggccgataatagccaccatttcaccactggcgatgtgcagcgaaacatcattaatcagcgcttgctgttgtacatgataatggaggtggctggcctctaataatgcgacgggtgttactgccatatcaaccactgcgttgctcccgctgacgtaaaatcagccacagaaaataaggcccacccaacaggctggttaacagaccgacgggcatttccgccggagcaaccagtgtgcgagccagtgtatcggccgtcagtagcaggcaggccccccccaacgccgcgccgggtagcaaccaacgatgatccgcgccgatacgcatacggatcagatgtggcaccaccaacccgataaagccgatcacgccactgaccgccaccgcggcaccaatcaggatggcactgagtagcagtaagcgtagtttggcttgccgaacattgacgccaaggtagtgtgcttcttcatcccccaactgcaacaaattcagttggcgggcctgtagcagccccaaaatacaggtaggcaggatcagggaggatgcgaccagcagtgtcgaccactgcgcttgccctaaactccccatactccatagcgagaactggcgtaattgttggtcatcactgatataggtcagcaccccaaccgccgcaccgcataaggcattaatcgcaataccggctagcagtagacgagccagattgccatgcccccaacggctgagggtaaaaataatagtagaaatagccagactgccgataaaggccccaaccatatggctatacagcgcgagtaacggcggtaggctgaaaggcatcacgataatcagcccgacgcaaagcgctgcgccgctactgatgcccaacaaacctgggtccgccagcgggttacggaataacccttgcataatggtgccggagaccgccaatgcacaccccaccacgacagccaataacacccgtggcaggcggatattcaaccaaatgtgccacatggcatcattggtggaggtgttccatagcgtgcgaaatgagagcgataaggcccccatattagctgagcccagcgccagaatgactagcaatatcagtaagaagcccagcatcagtcgtggctgaacacgaccattcattgcatctgttccattttttcacgtagctgtgcaagcacttgtggtgtttccagaccaaagccaagtaatgccatatcatccacgaccaacaggcgtttatgtttgccagccggagtcagtgccatacccggtaatttccagatatttgcactgctacccagcgctttaacgccatccgtggtgatcaataataaatctggcgcactggcgataaccccttcctgcgacagcgggcgataacggctaaagccctgcatcgcattactgccacccgccgcacggatcatggcatctgccgccgtattttggcccgcagccatcggtgttaacccgccatggctcatgacaaacagcactttcactggcagtggagtcttgttcacggcggccaagcgctgttggtagtcttcgatcagtttctgccctttctccgtctgatgaagtgccgtggcaacggcattaatcttcatcgcgacgctttcaggtgtcgtctggcctggtaccgtcactacattcacaccgctgctggcgatctgcgtcagcaccagtgagggctgagccagttcactaaccagcaacatggttggcttcatcgccaaaataccttccgcgttcagcgtgcgcatataaccaacatcaggcagcttttgcgctgcctgaggctgttgactggtgctgtcacgggccacaatctcatcacctgcaccgagtgcataggcaatttctgttacatctccaccaatagtcacaatacgttctgccgccaaggtatttagtggcagcagaggggcacagagcgacagaattaaggggagcgacagcaaccggagtctcatgcggcgatatccttgttgattaggcgggcaatctgttcacgccattggttttgttctggctgcccttcggtgcgctggccgtagagttgggcaagttgagtaccatcagcagcaaacagttctaggctggtgacaaaaccgtcttttgttggtttgcgggtgatccagctttcggcaatggccgtttcgatcagatgcagtgtaaagcgctgattgaagacattaatccattcgttgtgtggtgtgactttttcaatcaggccggtgaaaatttgtacacagccgcggttgccgacaaaaatcatgatctcgttctgatcttgctgggcgatgtgcaacagctgagtcagtgagttgttatcgacctggtaagccagatcatcaccaacagcgcggaacgcctgctgacgggtcagattattgcgtttaagcagttggaagaactggtgtacatcggtcatggcacgccattcgctatccacggttgcatcatcggctgtaggttctaccgcttctggggtgctcaaaggttctaactgcaatgccgggttttccgggatgataaattgtgccagcaaggcttcccaggcagacatatctgtctgttctgtcacatacactttgtgtaatgcatcgccctgatggtcgaaaaattggatgctatggcgcacgccgtggcgggtctcttcggtcagtgtaaaggcgcttgcccactgattcaggaataaccggaggtccaaggcgcgtggattgaggattaaccctgcatgaccatttaagtgttggttctcatagcggcccacttgctcatgaactgcataggtgttgcgggtaatggctttgacttcgccgacggattccaatgcggccaataatgcacgagcatcactttgtaaacgttttgcatcatgcccgacgcggctgtgggtcagctctgcttctgaaatccccatcagggtggctaaatcacgggcatatttgccagggtgctctgctttagcctgtacatattgttggtataatgatgcgttcataatggcttcctaattaattggtttttttgtatgcaggtaatcattgtcaaatgataatccggcaagccacaaaatggattaccggatgaatgatttcagactaactttttttcattagctaccactgataactcacgaaaaatttcacgttacggccatcttgtgggatgccttgtggcgcgtaatactctttttcgaaggcattacccaataacattgttgtggtcatgcctttgaatgcttcctggcctttatagctcacatagaaatcattgacgccataaccggcttgcggtgttgaactggaaacgcggctggagcgattagcgaaggtcccaatccaaccgacggagaaaccactgttggcgacaggtacatcaacgatactggtgacggtatccgggttgatggtgtcgagccattcatcggtattctgatttttaccacgggtgcggttataggccagatcccagttaaacaaggccgttttatagctcatgctggcatcccaaccccagatttttgcctgatcgatattcaccgatgtggtggtcatggcttgcatgtcaacgcgggtactgatgtagtctttagccttggtatcgaagtaactgactttaaattgcaggtcatcttcagccatcagtaaatcactgaaacgtaggccaaaaccgtattcctgggtctcattggtttctggtttcagatttgggttggggacccaatagttggtgagtgtcaacccaggccggatagggatcgcaaagtgtttggaatcgttatacatctcacccatggttggggcgcggaaagcctgagcataggagccaaacagcatcagccaatcagttggtgtaatgctgattgcaccacgtgatgaccatttatcggcatcgacatcggcatagccatcgctgctaccactgtaattgtcataacgcgtaccggctaatatggagacaggcaggtcgcgtaaggtgatttcatcttgtagccagcccgaactaaaccgaattttggcctgtgggaaactttccgttgccccaccgggggtctgttcctgtttataggtttcagtaccataggtcagcaagtgggaggctgggctttcgataaacagacgggtacggttttccagcttcacaccttcggttgtctgcttgcggccttcttcggctgaaccttgtggacgggcattgatttccacttcggagtaataaacctgtgccgtggcattcaaccattcttgatcgagaggcttaatattatatctgagctgggcatcacgctggatcgttgaacgattggtcatgacattggtactggatggtgcgctggtttgcggattctttggctctattgcactgttgttgtaataacgcagattggcgcttaacgattgaatcgagtctatctgccaagtgccttttgccaatacattactgatagtttcatcattcggggcattaaaaccgtcgctttgacgaatgttgccgatatcacgggtaccgaaagagaggataccatccagatcatcggtgcggccaaaggcgctggctcccagaccgaagctgtgatcacccgttgcggcagagctgtaaacccgataaccactgttttggcccggttgcagcatgtccgctgcatccacggtttcataggcaataaccccgccgagagcgccactgccgtacagcagtgctgctggcccacggacgatttcgatacgtttgactaacgcaggatcgaggaaagtggagttcaagtgaccggtatcggtcccctgacgaacaccatcaaccagtgtcaacacgccttgtttaccgtaacctcgcatcaccacatcttgaccgttggtacgcccgctgccagtgacggtcagccctggtacttgtcgcagcatatctgcggccgtcgcggcggtttggctggtaggggcattcccttcgattaccgttaccatcattggcgcttcaaaactgctacgctcattaccggttgctgtgacgaccatggtgtcggtgctgtgctttttactgctggtttgagtggttgtggtatcagcagcttgagtagcaaggggcaaggtacaagcgattgccaaactgagtgaggaccagcggaaacggtcggaagtggaacgaagcatgtcggcaattctccatattttttttcaaaaacatatcgataggttgctggctgccttgattcgaaaatctgggtggcttgcagtaagcgtcattcatacccttggtatatcttgggtacataaacgcgagttattttgtcagtataagttttccagatttggtctggcgcagttgatagcattcgccctgatggacgataaaggctacgccgtgctctcccagcaactgttcgctggcgatagacaaaggcttacgtgccaccgaatattcggtggcaggttcgtcatttaacattggcactttattcaactgtttatccatatggccaacaacttaatgataacgactatcagtgtgataagcattatcaggcatggtttgatattacatcaagacatatttgttgttaattcatttttaccttacgggctaatcctggctcaattaatgcataagcttgataatatgtcgcggggtcctcgatcatctgacttatatggtgtgcgacatctgcacgcgtgaccatgccatgggcttccgtttgcaggcgtattgcgttaccggtggcgggctgatccaataggccacccggccgaatcagggtataaatcaggttgctggtttgtaaccaactctcggccagtgatgtctcacgcactgcctgaccaaaagctgcgcgggcggcaggggagagggttggccaactatcgccacaaccgatcgatgtaaccaaaagcatacgcttcagccccagttgctcagccgtgtcaatgatcagccgattaccctgatagttcgcattgttattacccagcgtcgaaatgatagcggcgtcctcaccggctagttggcaggcttcgcgcacactggccggatcacaagcatcaccgcagaccacggtcagacctttgttgcgcaattcctctgcttgctgctgattacggatcaacaaggtgacaggacgaggattcgaggcagaatccgcatgttgatttgctaacgctagcagatgtgcgcctacgccacgacctgcaccaaatatcaaccatggcctcatggtgtttcctcttgttgtgtttgacgagtcttgttatttaaccagggtcgggtcttcaatcaggagctgttgagccaattgatggaatgcggcaaggccatcagcacgtaattgacgatgttcatcacggccaacatagactttaaacatcacttcaccctgttgattgaaaaactgtactgacgctgttgccattcccataaatgggcgttccagcagggcgattgcctggcaattttgtgctctgatatggccactgaggccttgtttactgcgtaaattgaaatagccatggcggtgagtcccgctcggtagtgggcctttgtgttccaaaatcacgtcggcggtatggactaaggtcgtgacatccccccactcggtcatgctgtcccatatacgatcaaaatgctctgcgcctaccaagactcgttcaggtaaggcacgcacaacatcaagtacgctgacctggtaatcctgtgcaatctgttccaaggtgccatccggttgggtggcaaggaattcagccagtggcgatctattcatagaggacgatctattcatagaggacgatgtatttatagacgatgacgtattcatgagtggctttccgctgtgatgagtgaaggaataatattttgcagtgcctgcatgatattgctggcccaaaaacgcccgctgtcggttaggcgcaggcagaaactgttatctttcagtagattgctttgataccactgggatatcaatggcatgagagggtacggatcggcaattaactcgctcaggtccagacgcccaacttcaataccactttgtaatttagcccgccacggatgttcgccgctggcttgcgtcatcatcattaacggtttctgcccactatcgattaaccgatagtagttatccagactacggtgctgcatgtaagcgtgcccttgcaaggagccccctgcaccactgcccaatgcgaggcaatcggccccttgcttgattaacaggttatacagattgcgctcacgggtggtccgcgcccagtggctgttgcttaactgatgccaacccgcctgtgcgaggctatctgccccgctgcagtaaaagtcgcattgttgtgccagtgtcggcagttccacccggttattttctaccgatttagccagcggtgtggtcggcaacaaattgagagcatacagatcaaccccatccagcgggagctgacgcacgatggctaaatcttcttgccagatttcgggagtttgatgcggtaaaccgaacattagatcacaaacaacagcagcccgatcacgggtcgccaaatcagtcagaaaacgaatcgcctgatcgcggtcagctttgcggcccattcgttgacgaatgcgggtgttaaacgtttgaaccccgatagagaaacggttagcccctgcttccagacaggcatcaattctctcatcatcaaaattaaaaattcgcccttcaacggtgatctcacaatcgggagctagcggtaaactcttgcgtaattggctgataatactgtgtaattgttgtgcggaaagtgcacttggtgtaccgccaccgaagtagatcgcatgaattggccccccttgtagcagtgggctatcggcttccatgctcagctctcgcaagaggtaatcggtatagcgttcggtgctaccggattgcagcgggttctggtagaaaccacagaaagtacagtgggtagcacagaatggaatgtgtaagtaaagtaaacgcttattgcgaggaagcgctttttgtaatagtgactgccagctatcctggagtgactctgcgggtaatggccggctgtcacgccacggcatcgtagcccaacgtttgggaaatggcagtggccctggttgggcataatacggcatcagatcaatattcatagcaagctcactaaaccacaggtgcgaaattaaatgataatcataagcattcgatcaatagctaatgtgaagtatcttgacctgtatcagtaaatggcgacaaacagtgcataaattagacaattgagggggagcaggccaaaattaggggcagtggacgagaccgatttggctccccgcaaagggtaacagctatcaagcaaaagaaatgggggttgatatagccccacccatcagagtgaggttattttggtgtatcatagccatcaggcaatatcacaattttaatgacagtctcagttctgcgctaatgcaacagaatctttcggtgtacaattccttattggaaaattttcttcataacatcaactttattcaaagtgaatacatgaagcctctccctttgattgagatattctctacagagaaagcgaattatctcaatcccgatgttttctttatcttcattactattgctcttactatttgcgaattttttaatccacaaagggtagtcgattgagttagatgaagtaaatttttcaataaatgaaaaattgccaagtggcattatggatggcgtaaagggtcgttctttatcaacccagtgactcaggaaatccaatgcattcgtgttgagtgtcagttggctgataaactcattaaccccgagttgatattttctttcattccagtctatttcttcttttacctctgtggtttccttgtgaaagtcagggtacaggctggttttgattccgatatgtttgtggctacggcgtatcagctcaatcaattcaaccccgtaattaatggggttatcttggtcgtacacatgcttgtcaccacgaatcacgaagaactcacaaatgcctacgtttatatatttttctataatctgcattatctccctttcttttttattatttattgtaatgtgaggtatcagggaaacatctgttttttctcttaactctatgacagtacgatatgtatcactccaaacagaggatccaatttctgtgttgactgtgtaataaataggatccagtgtgtcggtaaactcgataagtttaaatatattctccatttctttttcatttttagctgaattcatttcgaaacttagttttctttccataatgttctcttctttgtgtgggtataatctgtttaattaacgcaatcacgaataatttaaataacatttatttattgttgaatgcaaattaaatatcgtcgatataaatctaatggctaggaaatttttattgtttaatatcatatttagagttcgaggttatctattgagtaatgctatgcggggctcacggcaagagttgttgataatgatttactttttctctgacaatcgatggcgacagtgcccccgttgatagggaagcactgtcgatggcggtgtctaggagggaattgtagatttttctttttacattaaacgctttttttcccttttggaggctgactgacagagagcattaactcgctaatgtaggtgttaacgagtatttccacagcttcactacgggttatctcaagctgattaaccactcggtcaattttgcgtataacggacatgcgtagggagagtgaaatggatctctttttctctttgtccaaaataacgtggctggccaccagctcctcgtgtgattttattatcatatgcgaggcaatggcatctttaatgtggcgtagcacttttggcgtcagcgttcctttctcggtcaattggtaactgtgagtgcttttgctgtaacggatctctgcgttgtaggtttcccgcagttccttgagcgcacgggtgagcgttgggcctgaacagctcaacttatcgtatatgtcatccgcgtctactggtttgccactcgcgaggagcagggccagcgtgtagtgacgaaattgcttggtgctgagaagcatctttagttagtgccgcctttaatgggtggaatgattggcaggaaaatagggactgacgatattttcctctatacccttcgtacttaaccattactggggttagcggtacattttatcccaagtcactgatggtgtacgctcatcgggatacgcctaccaataaagccaaattatttagggatataacgcgatacatggccagtgcctccacgggataaaactctgtgaaacttatgatcccatcaagtttagcctttaagagaatccttgtcttatatgactaggctgcccacggtttatcggctaaaagagactcaaaaagcgttctatatatgagcgaacagctttgccaaattggctatattcgcgcttatgcccctttgcacatggcatgtcttatccactctgatgttttcttggcgcatcacgaaccgccatcgcagtaaaatcaggcattattccgtaatattgtgcacgctcaaggattgccgccgcccagcgcttatgagtagatggttcacacatcgccccctgagacttgaaaactgcctgtgttgaattgaggatgcgcaatgcatcagcgtgatcatgagtgtcgaccattaaggcgcgttgaatgacttcgatctggcttggatgaatggcggttttccccaccagaccatgagcgatatccagcgccagttctgtttccagcaactgcggattatctatttgctcacagaccggtgcggttaacgcaaaattctttggacagaataccgaaaccagcattttgatcacgtagcccatcgggccatcgtacagcgtcaacttacgcgagcgccgcatcgaaataacactcatcagatcattaccaccaatgcgcagcgcaacaatgcgttgacgagaggggtgattttccagctccctggcgagagtactcatcttcgctacatcaaagacatcttcagtttccagcgttggcatcatgcacagatgagtctctttcatgatctcccaccaggtagtaatggatgcttgggtaaactttggcaacacaaagccattgatagcgctcagattaaaacgggtgattaatgctagccccatcgcttcatgacgtggacgaacaaagatcagcggccaatgggcagacccatcgcgttttttctctacggctagcgtacctaatagggtgctgagttgagagatagccagtggcacatcatcttcgctcacggcatcttccaagcagattaccagtgagcgcaggccggaaattttattatgaataataatatcggcaatatcggtacgcgtagcaggcatataaagtgttgcccccaaagcgtacgcagaaggtgttgatttcatcagatgacctttttaattatggtgatagcacggtattggcccagttcattccccacttcttttattgcgattttcttctgtttggctaaatagaccagcaatgacacgtcaggatcgtcaatgtgacgaaccagaacatggtcaggtacacggcgaagaacggctcgggtcgcttcagcaattcccggtttgatgcgatttacgctattaatctcaaactgttccgccatctttttcaccacttgatggctttggatccgcagggcggcattttgctgataatcccactccgccgcgggtatctgggacagatcaagttgttggcgacagtcagcgacggtattcaccaacagttggctgcactcaaactcctgcaaatgctcacagtgaacacaaccgtgtagccctttttccgaccagagggaacgggagaccagccccgagactggcgcgcccataataccgaacgggataagccaatcatcatcggttgcagataaccaagaacagccacagggatcggccaacaccaccagacgaggcagctcggggtagcccggacgcccctgtagggagcgcgtcagttcaccggtgatcgcccctttacctgtccaaccgtcgacgaaaaccagcccttcggtgccgtgtttttgctcgatatatgacaaggcgacctcatcaatcccccggtcacggatgatactgataccgtagtgaaaagaggtttttcccaatgcgcggagagtgtgatggagcatcacaccaagtggtacgcccgcgcgtaccaagctggcgagcacgattggggtatcaccgaaacggttgattagggctttcgccagcatcaccacttcacgcgccatgcgtgtggccccttgatcgagtgctcgtgcaaacaaggtgaggtgatgctcggtcggcgctggctcctgactgagcatgtcagaataatggcgggcccctgactggatcagtttctctttaacctcgactggggtcatttcaatttgtattggtttgagcagaaattgaatgtcatctggcaaataggagccagaaaaaggcgtaatgtcatgcatcgttatctccattaacattatttttattaaatgtcgtgttatcaaataaatgcgatgtcagggcctgcgagaactgacttttcgcgggcataccgaaccaatgacagtggcgcataaagctgaagtcgctcaggctatcgccgaaacccagaaccggaaacgcgccatgttcgtggcgtaatttatcaagcagataagtggtcgccaggcctttttcgatacaaaccggtaaccacgcaatattgttgctgttacggtgaatataaaatccatcagtggaaaagagggattccagttggtcgttgaaggcatacaactcggctatctgtgtgctatcacggtgtttcatcacgaaataaaccggggtgtcgccgtattcataattgattcgacaccaggcattcaggccccgttcggccatcatgtcattgatacggctttccattgctatcaaacggtcacgatagggctgcaagttcgtcagcaccgtatcctgccagccggcatcgggttgtctgtcgggcgtcagaataacggcaccatgggtggtgatcgcccatgagctgaaaggaatgttgacgcggctgatctcttctgttccacgggcggtcacggggataaattctgcgtgctccaagagccaatccaccaacatggactgctcttcggtcatgaaactgcggggtgtcaggctgcgatccaacgcccctacccgaaaaggaggaaggtctagctcatcgaccattttgcgccgtgtctggaatagcgtatcgtccagatcacacaaaaaaacaggcttattcataagcaataacctccacacaaggtgccaccgtgcgaagctgttcaatcagcgtgggatcaatagattcggctggtgtttcgacacaaacgataatgcgatcaaaatgctgatgagcgacgttatagaggaaattggggatccctagaccgtagttatcgctgaacgcgatgattgagttaatagcatggccttgtgcaatcggtgagcgggttatcgagctaaatttgacgttagccccggcatgttccagcctctcagccaataagaaaggttgccagacaaactcactggtaccaaggaccagcactttttcaccggccagtacatggaccttatggccgatatcagcacgggtttcatccatgccgagccggccccaattttgtttatcggtgatggcaaccttgccacgggcagtgacattacaagcgggcatcacgggcaccggggcatcagggatgggtgaccagttccactccccggtgataagtgaaacggtggtgactggcaaagggcaccgttccgtcagtgcgctaccgctccagtcggtcagggtgacggcaaccaccttttcaaggccattcagattggcatcacgtaatgcctgaagaaggttgataaaggtgttccccgtggtggcctcatcgtcaataagaaccactgaacgggcgcgttgcaggcgtgcgcgcaacacggggtcagacggcaaatagagcaggtgatccgttgcatggctatggttttctttgaattcgcacagcaaatcgccatcaaccggatgccgggttgacgtcaaaaaaaccggttcagcgaccgtgccgcgtagctcttgaaatacaccagcagccagacctactgcagtttcagccatgccaataaacagaacggggcctggtaggtctgcagggaatctctccgccaattggcgatagacattgcgcatggtggcagggctaacagggatgtgccgccccagaactttgctaacaaaaaggaaggcgcgcttagggttacggcgttcggcaatatcaaagagcgaatccagcgggatattgctactgttaggtatcaccgtcaacgtgccccctgacaattcccggcgataaaccggcggttgggttgtcatcatgactgtcctttttagaaatgagtaagattttgcaattcagcggggaacggcagtgcatcggtcatcgctctcacgctgacaggcttaaaatgtgcaaccgcttgcgaactcacttcatcttgactcatcagatccagttgccgcagggcaaacaagcccggtaaattcacgccgctgtggcgggtatagccaataccgcctgaagggcgaaggttaatttccagtaacagcggttgcccgtggtgatcgcagcgagtttgaacattcaccagcccgtcagcctgcatcagctccgcactggatttagccagttcaaaggcggcacccgattggtgaaggtgctgtacgctgccttctttacggcgtgccacagctgcaatgactttgcctttttcaaccaacatgtcaacggaggattctgggccaggtagataaggcataagcaccatgggctgcattttttcagtgcgctcaagagcggccagatagagatctgggtgaacaacacgattatcggtacggtcaaagcagtccattgctgaaatggattgatccaatttccaaaaccccatgccgtagatgcctgtcacgggtttgatacagagtttttcagtatcaaaaggcgggttagccagccattcacgcaattcatcaggcgaagcgatctgaattgaagggacaacgggcaaacctttttgcgccatgtaagcggcgtattcgactttattatcagctaaagtaaaggttgctgggcactgcgcgccagtggtcaattttacgcccagcccttcaatggctgctcggtgctgctcaaaccagagacaactgcggccagtatgaatcgcttctatgtcgaatgctttcacgatatggcggataaacgccattttggtatcaagatccgatggttcgataaaagcgacatccgctttttcaagaatttcatagcgatgctgatgatgggaggcgaaaacctgaatagcattgccatgaagttcactggtgtttttcacaccggaaatgatgtccctttgggaagataatccccccatgaaccaaatattttttttcatcagtggatgaatccttatgaaaccgccaaagggaaggtgttaattgtctatgaatgaaaccttatccttaatcatattatgattgccatcttattgcactgatcaatttatttaaaataaataaaccacattcaatctattgtttatattgatatttaatgttctttacaaatcataatatgattcatgagttgaatgatgatggcttcatgatatgattggtgtgatgcggttaatgtgacttgttcaataatttcattctaaaaggaaacgtgatgatatcgttaagcaaaaaccaaactatctcactggcaaaagaaagcagtgccctctctcgcgtccagttcggtctgggttgggatccggttaaaaagaaaaaaagttttctgggtggtttgttcggtggtggtagcgctagcgatagcattgatctggatgccagctgtgtgatgttgagccagactggcaaacccgttgataccgtttcttttcgccatctcacgtccaagtgtcgttctgtgcaacatactggcgataacctcactggggaaggtgacggtgatgatgaagtcattaatgtcgatctgagccgcttgccggctgaagttgaatatctggcatttacggttaacagttttcgtgggcagaccttcaacgaagttgaaaatgcgttctgccgtgtagtcgatcaaaccggcaaagagcttgctcgttatgttctcactgagcaggggagccacaccggtatcgttatttcttctctgcgccgcaacaatggtcagtgggactttaccgctcatggacgtgcatgccgtggccgcactatcgaagacatgatgtctgaaatcattgagacggtggtgcgctgatgaatctgatgcctgggggcaatgcccctgttgcgtctcagacgctgacagtacgggttctgtccggtgcctccgttgatgtttctgcttttcggctctatgccagcggaaaagtccggggcgatacggatatggtgttttatggtcaaccggttacggatgatagcaccatccgtttgtctgggcagggagtaaatactgcgttttcagttaacctccaggccatcaatcatgatgtacaaaagatagcgttcacggccacctgcgacagtaaccaaaccctttcacagctaggcaacttgtcgatccaggtcgagctgaacggcagtgtgttgatgaagggcgatgtcgagacgcaggggcgtcaggaagcggcgcttattctgggtgaactgtatcgccgtaatactgagtggaaattccgctttgttgctcagggttttaacggcggtctcaagccgcttgccgaacattttggtgtggtggtagaagacgaacccgcggcacctactccggttcccactccggtttcaacccctgcgccaaccgcgccgccagtcgccaaaccgatcaatctgagcaaggtgtctctgacaaaagaaaaaccggtcatcagcctgacaaaacgtgatgatttcggtgagatccgcgtcaacctgaattggcaccgtggcggaggcgcgcccgcaaaaggtttcttgcagggcatctttaactcgaacaaggggatcgacctcgatttaggggcttttgtcgccttgaacgatggctcccgtggcgttattcaggcgttagggaacaattttggctcctaccacagtgaaccttatgttcagttacaaggcgatgatcgtactggcgatgtcagcgacggtgagtggatgcacattaatgggcgcgagtggaaacacgtcaaggaagtgctgatttttgcctttatttatgaaggtgttccgagttggggaagtaccgacgggatcgtaaccattaatgtccccggtcaggccccaatcgagacgcagatgaatgaagggaatgatcggaaaaatatgtgtgcggttgctcgtttggtgaatgaatcaggcaacatcaaagttgaacgaattaaccgctattttagcggacacaaagaaatggacgaggcttttggctggggattccgctggaaagcgggcagcaaataagccacgttaaacttttatttggaggaaatattatgagctttttcaataaagtgaaaaatgccatcagtgccgggcgcaccgaactgaccaatcaggttggccgctttaaaaaccgtaaattcatggaaggcactgtcgccgtctgcgcgcatatctcaatggcgagtaatggcgcgggtccggaagaaaaacaaaagatgatcatgttcatcaagcagtcgcctgaattaagcgtcttcgataccaatgaagtgatcgagttctttaacaaactggttaccagctatgaatttgatgctgacattggcaagggcgaggcgatgaagtacatcatggcgctcaaaagtcagccagaagcggcacagcttgctttgcgtgttggtattgctgttgcgaaaagcgacggtgtttttgatgaaatggaagaagccgcagcacgtgaaatttgcgtgacgttaggttttgtccctgctgattttcaactgtaatagcgaataatttgaggaattatggaatccacccatattggctttcccattgagacagtagccgtgttcatcctgctttctgtcggtgccatttgtatcgatcttttcatgcaccgccatgataagccaatctctctgaaaagtgcggcgttgtggtctctcttctgggtcgccatcgcttttgtattcgcaggcttcctttacctgcatcacggtgctgaggcagccagtttgtttgttactgggtatgcgcttgaaaaagtgttatccattgataacctgtttgtcatgatggctattttctcttggtttgcggtaccagaccgcttgcgccatcgcgtactgtattgggggattatcggggctatcgttttccgtggcattttcgtcgccattggtacgggcttgctgatgctagggccgtgggttgaggttgtcttcgcgatagttgttgcctggacggcagtaatgatgctgagaaaaggcgatgatgatgacgccattgaggattattcccaacatatcgcctatcgtttagtgaagcgtttcttccctatttggccaaaattgagaggcaatgcctttatattgagccagaaagaggttgatgcagaactggctaaacctgaaaatgcggatgtgcaagtaggccgtaaaggcggtgttgcacgttatgccacgccattgatgctctgtttggccgtggttgagctgtcagatgtgatgtttgcttttgactctgtaccggcggtgattgcggtcagccgtgaaccgttgatcgtctacagtgcgatgatgttcgcaatccttggcttgcgtacactgtattttgtacttgaagcgctgaagcagtatctcgtccatctcgaaaaagccgttattgtgctgttgttcttcatcgccgctaagttgggcctgaatgcatctgaccactttttcaatcacggctatgatatctcggccaatgttagcctgttcgtggtcattggtgtattggcgctcggtattgttgccagcttcctgttccctgaaaaggattcaaaggaaggacagcactaacgtagggttttagagacctgatgatgtaaattgaattaatacttaactactgaggaaatgaaaatgggtgtatctctttcgaaaggcggtaatgtctccctgagtaaagaagctccaacaatgacgaatgtgctgattggcctcggctgggatgcccgttctacagatggtcaggatttcgacctggatgcttcagcttttcttttgactgcaaacggcaaagtacgtaacgatgcagatttcattttctacaacaatctgaaatcatctgatggttcagtgatgcacaccggtgataaccgtactggtgaaggcgagggtgacgatgagtcgctgaaaatcaaattgcctttgatcccagcagatgtggataagattgttttcgttgtcactattcatgatgctcaggcgcgccgtcagagcttcggtcaggtggctaatgcctttattcgcctggtaaacgatgataatggcgttgaaattgcgcgttacgacctgtctgaagatgcgtccaccgaaacagcgatgctgtttggtgagctgtatcgccataatgcggagtggaaattccgtgcggtaggtcagggctatgcgggtggtttgtcgtctgtttgtgctcagtatggcatcaacgcatcttaatcattcccttcgtttttgacgttgcagggggtagctacgtcagcgtatccgttgaataaattcatcggggtttgctggttacttacctgtaacgccaatcattttgggtgtacagattaacgtattcatatattcagggcaaaatgctctgaatatttaacacttcagtgtaaggaaagtacgatggcagtttctctggtaaaaggtggtaacgtatctctgacaaaagaagctccaaccatgaacattgctgtcgtggggctgggttgggatgcacgtgtgaccgatggttctgaatttgaccttgatgcctcggtatttatggtcggtgaaaacggcaaagttttgtctgatcagcacttcatcttctttaacaacaaagtgagtccttgtggttctgttgttcatcagggtgataaccgtaccggtgctggtgacggtgacgatgagcagatcaaaattgatctgaaaaaagtcccagctgacgtgaagaaaattattttctcagtcaccatttatgatgctgaagcccgtaagcaaaactttggtatggtcagcaacagcttcatgcgtgtggtcaacgaagataacagcgcagaaattgctcgctttgacctatccgaggatgccagtactgaaaccgccatgatctttggcgagctataccgcaataatgacgaatggaaatttaaagctgtcggtcagggttttgccggtggtctgtctgcgctggcaagccagcatggtgtgtcggtataacgactgcccgtttcaattaaaccctgctgcatcggcagggttttttttcgctcaattttccttgtctacaccatctaagcacagctcctgcttcgtctgattgcgcgtagccaacacacatgaggcttgaagtatgatgggtatactcggcggatagaagagagataatgagttgaaatacaaaaattaaaatataggtgctcaaatttttacatgaatataatattcaaatggaatgaattttatatacccattataaatatgcgtgtatgtttaatatttaaaacttaaacgaatgtatatgaatatacagccagtttcttgatgaggttaattgttcattaatcattaaattatattaacttacttttttatatggattatttaaggcaatgaaacaattggtattacatagtgtaatttatgtttaatttattgtttttatggcaataattcatgggttaatgctgtggcagtcgtaggtaaatatattagataagaataaatccacatccgtgtaggaaatttcctacataaagtggcgtgcattctgatatacaactaaaataataaaacctttaatcagagcctaagtctggggtgtccattatttttaataataaattaatagatgtactcacactaagactttaatcctacattttatttttatgactcagcaataaacattataatatatcaggagttttaaatgaaaaagccattgactcaaattgcaatactgtcttctctggttgttagtattagtgccgctagcgcagcagtaccgaccgcagaattaaaagtcgtcggcactatgacagtaccaagttgtaccgtcgtttctccggacgcaggtatctacgatataggtaaactgtcttcttctctcgttaagccgggtactacagtgactgtactggcgcaaatcaacaaaacttggacggtaaactgtgatgccaatacttatctgaattttaccccggttgataaccgtgttggttcttcatctgacggttccgccgccgccttcggcttggggaagataaacgatacgggtaaaatcggttactacacggtacaaatgcggaacgcaactgttgatggtaaaaagtcaggtgtgtttactgcttcatcggcatcattctcccaagcggatacttcttacctgaatagaggccagcgtaccggctgggctgcgggtgctaacacacagaactctggtaaagtatttgttgctgatctccttgtgacgcctgttctggcaggtactaatacgatgaatggtgcgataacggaagacgctaagattgacggttccctaaccatgaactttgcatttgggatatagcgcgtaacaagcgggtatggccaaggctatttttgattggcaaaattattttttgtttaagataaccttggtcattcttcttattattaagacgtgtttttatgaaaacgtatttctataaagatagggttttttaaggatatagcgtcgatataccattgttttatttaactctagggtgatattcgatttttcaataatcaattcacctattagtttttattaataattaatttttcagggaattttcgtggtcgcccgttgtattaatctccagtgtatcgcattcttattctctttttttcctacgctggctttccctgtcacagaagagggtgaggtggtttttgacatagaaacgctggagagattaggttattcagctgaattggcaaaattcttcagcggtcaggatagatttctacccggccaacatgatgtcactatcattattaatgccagcaagacctaccgtattgcagcgaccttcgatagcgaagggaaactgtgtatggataaagcattactgatggccttgaaattacgaaatacagagagtgacggcagttgtgagaatatggaagcccggtggccgggtatggttgttaaactctttcccggccagttccgggtggaaataacattgccgcaagaggcgtttgatcccgaaatggaaggaagtgagtatcagcaaggagggcatgcactattgcttaattacaatatctttggccaacgggtcgaaagtaacaatagccgctttaatcttgttcaggggcaatttgaaccggggattaattttaaaaattgggtactgagaaaccgaggttcctacagttataatcaaggagtgagccaatactataatcaggaaacctctgctttacgcgcggttgaatcattgaaatccgtggttcaactgggtgaatttggtttagtgggtaacaccttttctggtttacccgtaaccggcattcagttgtattccgatgacgcacaacgggatgatacacaattgatcgtacccatcgaggggattgccaataccaatgccaccattgaaatccgtcagcgtgggcgggttatttatcgtaccatagtggcgccaggtcctttttcgttatccaatatcagtaacttctcaagtggtgttaacaccgatgtcagtattatcgaagaggatggcactcaacagaattttacggtgacgagcgcccttgatattaacgctgaacaacaggcatccatctaccaactggccgtgggccgttaccgggacatgtttaccggtgaggacaggccgtcaccgctgctgctttccggagaaatgtcattcaatccggcggctaccttttatatgacgtcggctgggttactgtcctctggctatcaaaatatccgtgtgcaaaatctttacagtggatgggatcaggcctggttttcagcggcagcaagttatgctaataccaaagatgcaggacagggataccaatttagcgttcagaatcagatgacgattaacggtaattttggtgtttcatggtcctcggtttatggctcggccaattactggtcaccggatgatgccctaagcagtagcaataatctgaatgacctgatgtttggaaaattaaaaaatgcaacgtcggtagccgtgagctgggtgcacccacgttggggggcattctcctatgctttatcaaataatatgtattatcaggcttctggtcgtacttaccatattttctcaattagcgaacaatttggccgggcgactaccatcttgagttctcaattaagttcgcaagggcaaaattcgctctatgttggtatcaatatgccattgggtaatgggacgttaagtggccgggtgcaacgtaacaatggcaatgtggcacttggtagtacttatcaagggcgatggggtgacaacaaagattattcggtagggatcagcggtgacaataggcaacggcgtatcaatggttcgatgaatataaggacggcctattcacaattaaccggtggggtttctcaagcgacaaacaatagccggtctgcatatctgtcatcgcgtggttcagtggcttacgtgaataacacctttgccacatcgtcgtcatcggttggcgatacttttgcggtggtgaacatacccaaccaacccggtttgcgcgtttcatcgccgagcagcggtattgcgattacggattatgctgggatagccttgctgccattagtgaggccttacaccgcttcgaaagtacaaataagcacgcaaacattgccgctgaatattcggcttaataacaccagtgccgatttgctgatgactcgaggctcggtagcaacccatcattttgagacaacagaaacccgccaattgctgctaaccatccgtggtagtgatggtgaaatgctgccgattggtgccaatgtattggatgaaaaaggtaactttctggggacgattatcggtgacggaaactttatgctggaaaataaggcgattggcgtgacattacgtgttaaggcaaataaccgcgatgaatgtcgcgttaactaccgtgaacctgaaaaatttgaccccgatgtattgtatgaagttgccgatgcggtctgtcagtaagttttacattataaaagcagcaatgacaaaaacagaccaaatgtgaagactttttgaatataggatctcttatgcaaaatttccccactcaccatcgtgatattggtgcgacaatcatatacgtaaatagcgtcaatcgttttaacatcttctttgtatttacgttgttgattttattgagtagttggagcgcagtatcttacgcgtcgtttaaattagaaagcacgacggtaatcttgcaagaaagtgaggctcgaaccagttttactatcgataatatctctagcaatccaatactgctggtgactaaattaacggatttggacggcaaaagtttcagtaagcagattttgatttcccccccagtgacccgtattaatgcagggcaaagccagcaagtgaattttgtcttgaagaaggggagcgtcttgaacaatgaagtgttgttaaaagcctcttttgaaggggttgaacaggtccccggtaatgcggcggttatgccaattcgtcaggagatcggctttctgatccagccgagtgctgtgccacaaattagaatgccgtggcaaacgttagttttctccatatcgggcaataatttggttattaagaatcctggtaaacatgtggtccgcttagggcctcagattattttagtcccaagtaatgaggtggttgcactgggtaatccttatattatgccggagacttccaaactgtttccgataacgtcatcacccactgccgttaaagtcaccccgctaagccgttatggttttgtccagactgaagtcacattgccggtaacgcgttaaggttattttgatgtggggcgatcatctttatacagagggcggtatttttttcccagtagtagaaattgatatgccgcaagagtttgccggttctgcaagagccattggttgtccgattggctatttaccgtctcttcggttacagactttatggttattttctcgatacctacctagggattcaaggcgttaattacgtgttttacattatggcggcgttcagtgcaggtcgttttatctgcgccgctgtctgggctaaataagtataccgttagccgttcgtttaactcagatgtgggatatatatattactttaattattagttttcaaatttctcacatcacagcaatatccatatgaattaaatgtgtattgggttgtgtttatataggtgttgatgggatgtgtgtttatgtctcattgcacattgggtaaaaaagggagcaagggctatttcgttatgcataggaagcctttgaataggttatttcacggtaacagctgctggccactgcgtaatccaacaccaggggagtcaccaatgggcagcgctgttacttgtgaatgccttgttctataagaattttacctgataaagggggtgtccacctttaggctgtcatctgctctatttttttctgttctaaatgttattaccttaatctacatccgccagtgaattatcatcgacttacctctcattcttgaataaaatatttgtaggaatattccttcaattaatgtcggcatttttttaaatttgattttcatgaaatttacttatacctttaataatatatggttatcgcgtttattgtatgaaatttcttacaaatcaatgtggcgtgttatttttttagttaccgtcttggttgtgttttgttacatttaactcgctggtattagttagttaatgtttttacactacaagctactagatttaatggatatgttcatgtgggtaaaaatatttgtcagagacagacggtttcagaccatccgataaatggagcgggttatctataaatattatttactttatacacactgagctaatccgtaggtggtgaatgctgtgccgggtagcgtagattatttttattcattctctctgtggtggatttcctaagtttcctttctttagtcaggaaagttgatgtcctcttcaagcttccaaaatgagatacctaaagcacgcattaacataaaatgggatctacatttagcgggatgcaaaagaaacgggagctgtcactgacataaggatgctgtcatgccgcaacatcaagatgtcttcgttatatgaaatattaatgtaaaaatttagcggtgggctggcgctatatcaggccggtgatgtcgagaaataagttttgtcagtgcttgataactttggagcggcctctgatccccaggtgctatccgcctaacgacttgattatcatggaggataatatgatgcatacagaaaacaattcccccccaggtttgatcccgttgcccgattggtatccggttgctttttcgcatctggatgcgatggagtacgcgagtgtgacgcggctttggcaccatgaacccgtgctgcgtgatctggtagacgagctggataaacgtaatccggggctgattacgtttacgcattgcccacattgtcacagtgccgatatttgccccggcacccgcccggaagagtaccgctgtcgaacctgccatcggtgcagttctccgtatacgcataccccgtttttcgatttacaccatgcccgacattcacggctctatgcggtactggtgaccctctggggaacctggcaagtggaggacgctgcctggttaagtgactgcaaatccaaacagatatggaagcagtactgccatcggctaaaacccattctggcgttgatcggcggccgtgcggtaacccatacacctcgctacttacggggttttacaccggggcagcaggggttgcactgcccagcctgcgcctccacgcaattggtctacagcgaaaccatgccagtaggtaatcccgaggtacactgtcaggtttgccagactgattttgtgatgtatcccgacattccaaaaggcatcgacccgtttgcagtcaatacgccacagtatgacatcccgcttccccgctggttcagccgcttgttttctcatgcgagccaggcacagtaccaacatttacgggaggtctggcaacgggaaccggtactgagagaggctgtggatcggctggatgcacaaaatcctgaacagggtgcggtgtatgcctgcccttactgccagaataagcacatcagcccacgtaaaacagcctcatctattgaggggtattattgccccgcctgtgataatccatttacggccactaccgggacggtatttacccggatgcgtcaggagcatttttggcgtttgtatgcggtattggtgatgctatggacacagtggcgaccaacacagatttttgagctatgtcagttacgttcagtgcacccctttctgacttaccataaacggctcgctccgctactggctgagtttgatggtgccccgatcacgccatatccccgtaatttactggggttcacccccgggcagcagggggtttgctgcgtgtattgccaatcgacaaagctgataacggaagggataacggtcatgccactggataacccctatatctgttgtctggactgtggacagcgatttatgctgcgggtctggcgaaaacaggtaaaaagtaacgagaaaaaataaatcccaaagagatggcttgctattttaaaaatgaatttattattattgataaaataacaagccagcaagggattgaaaagtatgttatttgattgtttgattttttaatcatgctaaaaaatgcaattgatattggtattgttaaatagacaatgaaggcggtaatattccactgtatcatttgcaaagaaactgcatataacaaacttgatgctatttgatatattctcacttctttttttatgagtaaataagcaactaaaaaataaaaagatgcaatgactaatgtgcccatttttataaaattctcatatttattaaagtaagagggttataccatatcacactgtatgtgtagacgatttaaataattgcatgaatcaaatcctccctttaacgcctttgtacctacgtgaacgctcatgcgccgctatacccgtaatactgcaaattgcaggtgcgtgagttgccttcgttcacccccagtcactgacttgtgtaaaatcttaaggattaatgaggcttatcccagaggcttaccctgtgagcagccgttgccgccttcctgcaactcggattattgtgggtatatgcgtgtttacacaaaaaataaaaaatggaaaaaccaaaacccaaagaggaaaaatggatattttgacaatagattcgacaggtaagcatattatttttatggctaaaaataatatattgaacacctgaccttttttggcactcagccatctaaaaattgaatttgatataaatgtaacaaaagaaataattagccatgtatatccgtcatatttcatgttgcatatgccttggccgccttcctgcaactcgaattattttgggtatattttctttaaataatggtcgtgactcgactgaaaattcacatttcttgagcgggtcccactatcgttaatgcaaaaaaaatcagaacggctgctttagcgtataggttagtttcaggactgttctctgtatatcgacaggggttaaccgatgaagattattgataaaaatgtcagtacctatgaaacgttacaaaagggttttaatttacgttggccacccaacgttgagcagggtgctgagaccatttatatctgcacgacacccgatgaagtttttgccgccgccaatactgcgctagctgcaggaaatcgaatcacggtacggagtggggggcactgttatgagggttttgtttccaacaagttatctacagagagattgtcgatcattgatttaggcgagatgagcggcctggactacgatgaagacaaaacgataacctcactttgggacgcgaataaaaatacttatcgcttcaagagtctgacggggaatcagaattggaatggctatgtctcactctacaaacggtctggccggacgatccccggcgggtcatgttactccgtgggcgtgggtgggcacatcagcggcggtggctatggattactctcacgtctgcatgggttaacagtggattgggtcactggtgttgatattttggtgccggtcgggaacgcgcatcggctggcatttcgacatgtgcgcgctgatagtgtgtctgaggtagacagagagctattcatggcttgctgtggcgctggcggtgggaatttcggcatcattatcgcctattatttcgatgatcttcccaaagcacctcagaaagcctattggatacccctaacgtacccatggtcatctttaaaagcgacattccccgcctttttaaaagcttattggcaatggtttgctgacaatgatgttaatgcgaccagtacgaaggagggcgtcggtaatggcgggttatttactttactgaaattaaaccatatcgatgcgtccgataatgtcgtgttggccattcaatacacgggtccaaatggtcaagtcgggggcgcgaatgatattcctctcaatgactttatcgaaaaaatgaatgccgcggctggcatgacaccgacgatatatgatgattttattttgccaaacatcccgccgtttaagcacttgtacccaggtcgaaaaatcgggcgtactgtggatgaaagtgcctccatggattggttgcatgtgactcaaatgatcaatgggtcaggcagtaatcagcgtggaaaatataaatctgactaccaaatcaagcagttttcagacgagatgtgccatgccttgctgacacacttgactaccgccacagctgataagcgtttcaatcagtcgctggtacaaattgattcctatggtggggcgatcaacagccgtggcatcggggcaacagctgtgtctcaaaggaactcgctgctcaaagcgcaataccagacttattggacgaatgaagccgatgaccagacgcacttaacatggatccgcaatatttatgcggcagtgcataatggcaaacctgctcctcctgagttcgagggatgctatatcaattatcccgatatcgacatgaaatacaccgattcaggtgaggaagatccaaattggttgaatctgtactatggctgggatacgcaattgatcaagaggttgattgcgctaaaagcgagaatcgatcctaacaatatttttcaccatgaactgtctatcccattagtgacagaattacctaaagccccggttaatctccacagcacggggcaaacgacaaccagtattagtctcatgtgggggagctcgataggggcattacctgttgccagctatgccatttaccgcgatggtcatgaagtgaaacttctgaacggaacccagacttcagcagaagatgccggtttgcaaccaaatacggagtaccgctattttgttgccgcaggcgatgaacatggcaacctgtcagtgcccagcaatgtactgacggtgagcacccaaggcacacacccggcatgggtactgaatgggagttacgctgttggtgatgtggtaagcaatctgggtaaactctggcgctgtattcagtcgcacgtagcctatgatccattatgggctccggggactaacggtggtattacgctatgggcggggtataccgcaggtcgttaatccaacaggaggtgccgagaggcacctcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcaggtgccgagaggcacctccgactgttgacagcgctgataaattaaaggggaacgtaccgttggggtcgtagcggcctgagccgccggatcctgtgttcaaccctttacgcactgcgctataaaacgatttacccgctaatataaaacgatttaccagctcactcgtgcacctatcgtgccgccgacggcatagttgtcactgacattccgtgtagcccccagcagattgacattgccgtaaaccgcgtagcgaccattctgccattcatacgtaccgcccgcgcctaaccccaccgactgacgctcatcccgggtggcgaactccacccctgagacctgtactttgctgccattgaggaactcattgtgcagatcgagatgactgtaaatgtgtgagcggcgggtggtgccgtctttcgcactccaggtcgtttccttatccagtgagacaccgaggcggccccgcaggctgtcaccctcttgcagcgagacttcgctatcaaacggatcgcggaaggtatcgaaatcgacccgcgagtaggtcacctgcatctgcggagtcagcgataacccgttacccagtgcgtaacctttaccggcttctatcgccgaggtatacccacggccattattgccactggccaccgcatgccctgcggtacgggagctcaggtcgctgtcaaaccacatcgtctgcaactggccatccacatacacgccgttattgccataccaggtcaggctggtgccaagaccgtaacctgcgctgttgatgcggccatcaccaaagaatgagtggatatccgctttggcttttccgtaggtgaagttcaccccgccggtcagcagtgaaccgccctggctctgatacaacggcacatcaatgccggtctgcaacttccacacatcaatctcacgctgtgaaccgctggtggatcgggccgggtcggtgacctggtggctcccttcaatacggccccaggcccattgattatcgtcaaagttcagatctgccagtgcgcccggtgccccgtaacggttaccgacacgctgttgcagcgtcggcagggtattcagggcggccagcacctgcggatattgttcatacagcggcacgcccacctgatagcgtaccccctcggttaacatcagttctgaagagagataccagttgcgccccgcagtggcggcttccccgtcggcctgtaaagtgtaggcatacgccccggccaccaccgcctgatagccatccgtggtgacataatccccggccagcaggaaggtgtcatcctgcgccagaccgtccacggtgatcagattgatgccattgagggttttatcgcccagaccgcccgcattgttcacccggaccgaggtggtgccggtggcatcgccgttgatcactaaccggtcggtggcagaatcgtcatcccccagcaccgtatcgagtgccagccaggccccttcaccggaaccgttattttcaccaaaataagtcccggtcacggtcagccgatcgtcggtagcggcaccattgccgccggtataggtgtttgacagcaggatcccaccggcgctgatgaggttgccgctcaggaccgagtcaccgagtgaggacagcgcgccgccttcagccagggttaatgcaccggtttcggtagccactagcgtcgggtcagcggcgatatcggcggcactgaggcgatttaatatggtggtggcaggcgtcaggcccaacgtggcgttatccagcaccaaaatccccccggcgatattggccgacaggaaggcattggcgtcaccgtcagccatattggcgccggttaacgtccagatactgttattggttttggtcagggtaccgaagccggtgatccggttcgggtcgccatccagaatggcctcttcacggttatcaatacgcgtgagatcgaaagcagcgtcccctgttccccccagcaccagatggctgtttgccagatccaacgcggcatcattgatctccgcataactgccattgaagaccagtgcctgcgtaacgccttcaagggcatagccagattgcagctctaacgtggccgatgtttgaatgttatcaagccgatgaatgccgattgcggtgccattgccgccgtgcaccaagccgcccacggtgacataggtgtctgcggtattggtttcaatattaattccgtagccctgctgcgaaaccagcgcgccccgggtgatcaaatcaatggtcgaggtgccgttgtctgcgcctgtgccatcatccacgcctgtggcgtagttatcattatagttatagttatagaggcgtatggcatcgtattcactggcaatattattgacgtcaacgttgaccaaagtgcggccatcagtggtcagtgcattaagggtaatcccctctccgtggctgacgttaatctggcccgtcacggtgatatcggtggttgaagtaccttggttagcttcgttaatgagagatattccactgctcattgcagtgatgtcattgaagtggatgagcgtggtggcatcccccagagaggaatgggtctggagcattgccccttgtccccattccgctgtgagatgcccggtcgcggtaatggcagaaaaagctgaacccaaaaaattgtaattgttgatatcaagcgattgactgctggaagtaatattattcacattgatgagcatagtagaactgccttcaccagccgcgcccatcactttaattccggtaccgttttctgcagtaatcgttcctgaaatatcaaggtcatgcagtatatttccggatcgggtatagtcgctaatattgagtgcatcatacaaagaataaacgttattcaacttgatagcggtctcgatgtttccctcatccgagtaggcattggcttgtagagcagatcctgaagtagccgtaagatcacccgtcaatataatatcggttacagcgccattttggctgctattatcgatataaaggccagtcgatccagtgacattatttgcgcgaaatctaaggctcgcaagaccgccattggtataattgtaaatcctggctgcttgactattagctgaactgatatcgccatcaatattgatatcagttatcactccacctacataattggtattttgaatataaaaactgtcatattctgtattaatactctttgaattgaagttaattatgctggtgccaccattggcagcatttcggatcgagacgcctgaattttcgacgttaatatcaccagtaacatcaacgtgggtgatggtcgctccattttgtgaattattatcgctttggatgccagtaacacctgaaatagcgtgggtgttcagaatgatagttgaatcattgcctgccgatgaaaagattgaaagggctggagcgccgctcaggctgctggataagatgccagagagatctacccgtatggtcgaatcgtcactgctctggttgtcaatgtaaacgccactgctaatggagccgttgctctgaacattaatggatgccgattgctcggttattaatgtgtcattcttaatatacaaagaatatcgactgtcggtatccagtgcagaactgttggtatcgaggtaactgatagtacccgaaccggttaacgagagcgcagaatccgtaatttcatgttctgttatgccaaaaccgggccgggtctcaacggcgatatccgtgccgaacagggatatcgcggtgttattttcaccttcgcaaacataggttcccacccccgagctattgcacgccgcccatgcggtttgtggtaagacgagggtggagaacgcaacaataattgccaatgtaatcggattcatcacggctgcaggaacacggctgaagaggtgttgacgccctgcatccggttgagcgggtgaggtagaaataggctctctgaattgtatatgcataaatgtactctattaattgcctgaatttatcgcagacatggcatatcactaggggttgctgaaattgcataattcagacacaggcagagtatgggaggatagatctctccttttgcactatctcaatatgatcagcaaacatgaggagtgacttaggttctgtcggttgttgagtcactaaaatgaaattattgtttcttaagatgaatagtaaatgaaggaagataaataagaataagacccggctaattctttgtaggaattttcttgttattgtttttttggggattaataggtccaatggggggggtaatggaagtttctaacaattaatgttaattaccatgacattttaattacttgtaatgagattggttaattaaatggttggatttttattggttcgcgttaataatgttgcttatcatgatggtttatcgtaacggtaatttatcgtaatgatcgcttattgatgcattacctataatctaaattttacagataatacggcatttttacttactggctattttcttcgccacggacacgttgtcaataacctctgctatttataaccgctgatatttataatctctggtatctctaaccaaatatctgtttttatcagagcatggcaccctgtatttcccgctgatttaagccgcctattgctgttctattattggcccctgtctgggggtaatcctctgttgtggctatggtaatcagatgtgactgcccgtgtcgccgggtacctattctgcgctacaatagcgttctgtttactaattgcgggggtggctgttttaccctcggcagggagcgtttcgcatgtttatcggtgatgcatcaattttaaaacctatccaatggtgtgctaccgagcaccctgaacttcctgcagacatcgcagactggctgatggagctgggttcgatgactcgacgctttgagcagcattgccagcgtgttcatgtcgaaccgcaacgtgaatgctttattacgcgtgatgcgctaggggaagaggctgaacatttgcccgttagtcaacgctattggttacgggaaattgtcttgtttggtgacaatgtgccttggttactggggcgcacggttatcccggaggagacactgtctggtccggatagggcgctggtggatttaggtacattaccgctagggcgttacttattcagtggtgatgccctaacccgggactatattcacgtcgggcggcaggataatctatgggccaggcggtctttgctacgcctttcaggcaatccactgttattgactgaggtttttttaccggcatcgccgctttatacccattgtgactctatacccaagtgacttctaggtgcaggtaggcagcaagtgaacggatcctgatgtgctggcttaagccagtgattccggtaggcgaataccgttgacctccctgccacattcaagatgaaaagggtatatcaggtttaagctagctgattccgtcgttagattctggagactgatcaattgaagggaagtactgttcataccaaatggcaggcttattgccgtttgatgcgtattgacaaaccgattggctcactgctgctgctgtggccaacattgtgggcattgtggttagcagggagaggcatccccgaggccaaaatactggtcgtttttgtactgggggtctttttcatgcgtgcggcagggtgtgtcgtcaatgattatgctgaccgccatattgatggttttgtcaaacgcaccgcatcccggccactgcctagcggcactatcagtgagaaagagagcaaaattctatttgtggtattgatattgctctcttttggtttggtattgaccctcaatagcatgacgatatggctgtcactggccgcattggcactggcttggatctatccatttatgaagcgggtgactcatctgccgcaggtggtattaggcgcagcatttggttggtctattccgatggggtttgccgccgttagcgaaagcttgccgctggtctgctggctactgttgctggcaaatatctgctggaccgtggcctatgacactcaatacgccatggttgatcgtgacgatgacctaagaattggggttaaatctacggcgattctgtttggtcaacatgacaaattgattatcggcttgctgcaactggcgacgttattattaatggtggccattggctggctaatgaatctgggcggtgcattttattggtcaatccttctcgctggtgctctgtttactcatcaacagaaaatgatcgcccagcgtgagcgtgagccgtgttttcgtgcgtttttgaacaataattacgtggggttggttttgtttctcgggatattgatcagttactggtaacccgcttttactgggggttagcgatgactgagtatgagcgcagagtcctctcaccaagataccgagttctcaccaaggtaatggtaaaaaatggccggataatgagtccggccattgttatggtattcagaaaaccccctgctaggcagggggctgttaagcattgagtacgctaagacattaggattccgttttaccctcaggctctggtgtctctggtgtctctggtgtctctggtgtctctggagcttctggctgattgctggtctccgctggcatactgacactttcgatagtcagcttcacttctggggtcatcaacgcactcagcatattgtaaacttccagcgtatgttcctgaatggcatcaccgctatcactgatatagccttcttcacgcaaggtcgcaaccagcgttgagaagaccgctttatcaaagaattccggcgcattaataccatgcagaaccgacaagcgctgcgccataatgcggctctctttctccaatgccccacggttgatactgggggtagcgctgaggagtgaaagtgtgatcgcgtagcgttgtagcgtttcccgcacacctgcggccagcaattgcagtgggcgaatgcgtgccggattcaggaccaattcgctgcctttatcacaaattaactgctgacgagccagctcatcgatcaatgtatccagagtctctggtagctgctctttgctgtaatgcaggaacagttcagcttttagcattggatagatcatgctgattttgtgcagtaactccgtccgggtaatccggcggtggtacatgaccatactggcaatcagcgatggcaatatcagtaagtgctgaatattattgcgataataggtcatcagcacggcctgttcccgtggcaggatgatgatgtcaccgatggtgtctttctccacctcaaacttattcatattcaaggcgtgattaagcaactcttccggtgttttatccggcacggtagtatcttttgcatagggtgcattgcgcattaattgcagatagcaatcaagttgctcaagtagctgctcgcgggttagtgaacgctgacgtgaggcgagtaacgccgttgaacagagattcatggcatttgctgctgccgcattgttgattcggaccataatctgattagccaaatcattcactgccggtgttagccaacttgggcgctgtgcttcaatgggatcgatggcatcccgccactgtggcacatgggtattaaggtaggtcgtcaatggcaggggttcgccaaagttcacatagccctggccgagattacgcaacttacgtaagccacgtagcatctgtaacaggttctctttttcttttatcgcaccgcgcaactctttggcgtaagtccccacttccataacatgctcgtagccgatgtaaatcggcaccaacgtgatagggcgggtgccaccacgtaacatggcctgaatcgtcatcgacaaggtgccggttttcggctccaacaggcggccagtccgcgaacgtcccccttcaacaaagtattcaacggaatagccacgagtaaatagctcacccagatattcgcggaacaccgttgagtagagtttattgcctttaaaggtacggcggataaagaatgcgcctaaacggcggaagattggcccggcaggccagaagttgaggttaatccctgcggcgatatgcggtgggaccagcccctgatggtagagcacataggagagcagcaggtaatccatatggctgcgatgacaaggtacatagacgatctcatggccatcttgtgccaattgccggacccgctctgcattatgaacgttaatcccctgatacaaacggttccacgtccagctaagtacccgatcagacaaccgcacggcttcataggagaaattagccgcaatctcttccatcagagtgatggcgttttgctgtgctttttcatgggagatttttttcgaccgcgcctcgtcagcgacagctttctcgatagccttagaggccaagagttttttaaacagatcctgacgggcaggtaaactcggacctaccgcggccaaacgttgacgagagaagtgcatccgcgccacacgtgccagtttatgggcgatagttttatcggtaccgtgctcactggccattcggcgtagcgatacggtggtagaaaaacgcacaaaactgtcgcgccccaaccacaatacagcaaagaatttctgtacaccgttaagcacccgcagatgtggcgtaccgtggccttcgcgcccaggggaacggccaaacatcacggaaacgggtaacatctgaatatctagcgccggattattacgatgtaaatccagataatcgtggaatagcttcaccgattcttgtttaggaacatagtagcgaaagactcttggcccgttctcgataaacacatggctgggcaattgcacgccatcgatttccaatggaatcaatggatcgggcagatcttgcgccaagcactgtgcccgtaacgtcagcaaatcagccttagaattgtaaggtaaaacgtacagaataggacgagaagggtctagccctagctcagagaccggatctgcagggataaccttgctttttaccaacaatttgagtggtaaattcagtaacttataatatattttacgccaacctgacataacgacttggagcctcttgttagcaattcgtcgcaaggataccagaaactggttttgagatctgtggagatgagacaacagaaaatggcaaaaatcacgattaacataagataaaggcaaataaaccatggcgaatcaatcaacaggacttacccggatctataaagccgcgggttatacggtgaaagggttaaccgccgcctggaataatgaagcggctttccgtcaagaaagcgttgctgccgtcatcgctatcatactggccttctggttggatgtgggtgccatagcgcgcattttattaatttgcagcgttgttttggtgctcattgttgaagtcattaacagtgcgattgaagcggtagttgataggatcggtagtgaatttcatgcgctttctggacgggcaaaagatatggggtctgctgctgtgtttttgaccattttgatggcgctattcgtatggataacagtactctggcagcatgtcgctcgctaatgaggctaagggtgctgttaaaatgagcagttattaatccctgtttttattcagtctttggttcccaacacccgcttagctgtatatactcacagcaaaactgtataaacaaacagggggcggaatgaaagcactaactaccagacagcaagaggtttatgacctggtccgcgatcacctagcgcaaacaggtatgccaccgacccgtgccgagattgcacagcgtctggggtttcgctctcctaacgctgctgaagagcatttaaaagcgctggcccgtaaaggtgtcattgaaattgtctcaggagcttcccgtggcattcgtttgctgatggaagaagaagagggcttgccactgattggccgggttgccgcaggtgagccattgctggcacagcaacatattgaagggcattataaagttgacccatccctgttcaagccaggtgcggatttcctgctgcgggttaatgggatgtcgatgagagatatcggtattctagatggtgacttgttggcggtacataaaacgcaggatgtgcgtaatgggcaagttgtcgtcgcgcgcattgatgatgaagtcacggtaaaacgtttgaaaaaacaaggtaatatcgtgcatctcttaccagaaaacagcgagtttcagcctatcgttgttgatctgcgtgagcagagttttaccattgaaggtttggccgtcggagttatccgtaacggggactggatctgatctgagtgattttcctcccggaataataagccgtgcctgttgaggtacggctctatttcatgattctctattctgctttttgctttttgctttttgctttttgctttttgctttttgctttttgctttttgctttttgctttttgctttttgctttttgctgttctatctcatcttaatcacgatacgacttcttattaatcaagatattacttctttttaacgacgatggagtggtcatgctcacaatcatcgtggctttcgcaggcttcaactaccccacattcagtacataaaccgtgtgcttccaccacgctatggcgcagtgtaaaacctgactgttttgctaactgtgccaatgcctcttcaataccaacggtagggcgttctgtcacaatcttgcagcgatcacagataaacaaggcagaagtatgcgtgggttcttcaaagtggtggcagagaacatagctattggctgattcaacacggtgaataaacccttgctccaataaaaaatccagtgcgcgataaacggtaggcggtttggcttgtggctcagcgactcgtagtagatccagcagatcataagcgctaattgcaccgggctgttgcgccattagacgtaatacttcaagacgttgcggggtcagccggacgtttcgttgttggcacaggctttcagcttgtgcgagcagcttttcctgattgatagggttcatcatattcatcccgcagctttagaattgaacgtgattttatcatgtttacctgtaatcgccgataggggggagggaaatggcgctatgagatcacaattttacaggaataacgtgacgttactgtttaacgatcacatcagctgtcgtcgcagggttctatggtataatcaacggttccacccctttgtatcgttcgctcagtgagcaacatctgggggaaattaatgcagtaataactgatgaaatcaccgtaaatgcacgaagctcagactttttccagtacgccggccaccaagccgcaataccccctgcaacgcttctccgtcgcgccgatgctcgattggacggatcgccattgccgttattttcaccgcctgctcactaagcaagctctgttgtataccgaaatggtgaccaccggcgcgattatccacggtaaagccgattatctggcttatagcgagcaggaccatccggtcgctttgcaattagggggcagcgatccacaggcattggcgcactgtgccaagctggctgagcaacgcggttataacgaaatcaatctgaatgtgggttgtccgtcagatcgagtacaaaatggccgctttggtgcttgtttgatgggggaggccgatctggttgccgattgcattaaagctatgcgtgatgcggtagctattccggtgacggtaaaaacccgtattgggattgaccaactggatagctatgagtttctatgcgaattcgtgcaaaccgtcgcagaacgtggcgaatgcgaaattttcactattcatgcccgtaaagcctggctctcagggctaagcccgaaagagaatcgtgaagtaccgccactggattatgagcgtgtttatcagcttaagcgtgatttccctgcgttgacgattgccattaatggtggggtgaaaacattggctgaagctaaagagcacctcaagcaccttgatggcgtgatgatgggccgtgaagcctatcagaatccgggaattttgacgcaagtagaccgcgagctgtttgatcctcacgcgccagtggttgatagcgttaaagccattgaggcgctgtatccttatattgagcaggaattgtctcaaggggcctatttgggccacataacccgccatattctgggtattttccaaggaatccccggagcgcgccaatggcgtcggcatttaagcgaaaatgcccataagcccggagcgggggtttctgttgtggaggaggctttagcgctggtatccccttcgtactacgaatccgtagggggttagcggcgttcgttacttgtcctcttctacaaataattattatacacatatgggcttcacctctgcgaggccgctgtcagccgtattcaaatatgctttcggcaaattgggcccccgaattatttactggcgtaagtgattcggggttcactcattcacttgctacctgacgatgacgctaatgacgctaagtatctgaaagagtaaattcgctaaaagttagctaaattgactatgttcattttctttattggttagctatttattatatttacaataaattcaatgaattatttttacggccgcattggcacgtttcttgtaagaccctcctatataccctaaataattcgagttgtaggaaggcggcaagcgagagagttccgatgagtttactgtagtcagtgattcgggtgattgagcgtagccaacgcacctgcagcttgaagtatggcggctatagagcgtttctttttttgctaccgtattcggcgatgaaccaccattaaggggacaccatgttagaaattttctttgtgatcggtttttttatggtgcttatggtcacgggtatttctttgcttgggatcttggctgcactgctggtagcagcggtatttatgatgctaggcgggttatttgtgatgatgattaagctattaccgtggttgattctggccgtggtggtggcttggatttggcggtcaatgcaaaaaccggtgatacggcgttactgataatacgccgcttaatggctacgcagagtttgttgagtctatttttctttcttgcggcagcgatcacagcctgaaatattagtcggcagaattatgggggaaagcgtattttttcccggatcggcttgctaggatgctacccgataccgtttggtatcatatattcatccctgttagagataaaaatagccgtataaacggcacgttcatttacgtgaacatagctctgacagaatccctgctgtacccctacatatgcatcaaagaaagtgtaatgacagagggctccttaatcggggccctctgtttttcaatcatgtaaactcattttcaatcatctaaacttacgggatcagcaagctggagcctgtcgtctggcggccctcgagtgtttcatgggcgcgttgtgcgtcacatagcgggaattgctgcgcttgagcaacatccacattaatcgccccactggtaatcattgaaaagagttgctggctggcgctttccagttcttgccggttggcgacatagacattcagtgaagggcgggtgacatagatcccccctttttggtttagaatcccgaggttgacacccgttaccggcccagaggcattaccaaagctaaccagcaggccccggcgctttaagctatcaagcgaggcttcccaagtgcttttcccaaccgagtcatacacgacgcctactttctcaccctcggttagctcggccacccgctgagcaatattttctgtccgatagttgatggtcgcccaagccccggccgctttggccaattgggctttctcatcggatcccaccgtgccgatcaatttggcacccagtgctttggcccattggcaggcaatcagcccaacccctcccgccgcagcgtggaacaggaacacttcccccggtttaatctcgtgggtctggcgcaacaaataataggcagtcagcccttttaaaaacgaggctgccgcttgttcaaaagagatctgctccggcagtaaggcgattttatccgctggaacattatgcacttcgctgtaagcaccgagagcggattgggcatacaccacccgatcaccgaccttcacggaactgaccgccgcccccactttactgacgataccggccgcttctgtacctaaaccactgggcaaatgggcaggaggataaagcccgctgcggacataagtatcgatataattgataccgatagctttattttcgacctggacttcatggggggcggggtctgagggggtgaattcaagatattgcaatacatctggtccacccgtggtggtaaattgaatatgctttgccatgtcagttcctcgaggtatagccttcttacttgaggttacaagggcgctctgttcactcacctgactcactgacggatatcagcttatcgggatttgtgcgcggccaccggctcgtaacgccaatgattttggtatggatggattttcaccctacagggttcgtgactcggtgccaagtcatgactcataccaatatgtcatcgggaattccgtggctatataattaccccttcggatatcatcgcgtatactaggccgttatattttttagtcgcgctttttctattcgtcctttttctatttgcaataataaaggtaaagaacactcttcatggcagcgaaaaaaccaaccaacaagatgaccgagccacgagaccgccagatggaagggctgaagcttccgccgcattcgctggaggctgagcagtccgtgttgggcggtttgatgctggataacgaacgttgggataacgtatcagaacgtgtcgccagcaaggactttttcagccgcccgcatcgccggatctttactgaaatgcagcgcttgttggaaaacagcaagccgatcgacttgatcaccttgtccgaatcgctagagcaaaaaggcgatttagactcggtggggggctttgcctatctggccgaactatccaaaaacacgccaagtgcggcgaatatcggtgcttatgccgatatcgtgcgtgaacgtgccgtggttcgtgaaatgatctctgtggcgaatgagatcgccgatgccggctacgatccccaagggcgcagcagtgaagatctgctggatttggcggagtccaaagttttccaaatcgcagaaagccgcgccagtaaagatgaaggtcctaaaagcgttgatcgcattctggaagataccgtcgcccgtattgaacaactttatcagcgcccacacgatggcgtcactggtgtttcaacgggctttactgatctcgataaaaagaccgctgggctacaaaaatccgatctgatcattgtggcggcccgtccatcaatggggaaaaccacctttgcgatgaacctgtgtgaaaacgcggcgatgatgcaggacaaaccggtgttgatcttcagcctggagatgcccggcgatcagatcatgatgcgtatgctggcatccttgtcacatgtcgatcagacccgcatccgtaccgggcagttagatgatgaggattgggcgcgtatttccagcaccatgggcatattgatggaaaaacgcaatatgtacatcgatgactcctcgggtctgacaccaacggaagtccgctctcgtgcgcggcgtatcttccgtgaacacggggggttgagcctgatcatgatcgactacctgcaattaatgcgggtgccgtccttgtcggataaccgtacgctcgaaatcgcggaaatttcacgctcactgaaagccttggcgaaagagctgcaagtgccggtagtcgcgctctcccagcttaaccgtagtttggagcagcgtgccgataagcgcccggttaactccgacttgcgtgagtccggatcgattgagcaggatgccgacttaatcatgtttatttaccgtgatgaggtttatcacgaaaacagtgatgagaaagggatcgcacaaattattttgggtaaacagcgtaatggcccgatcggttccgttcgtctgaaatttaacggtcagtggtcacgttttgataactatgcgggtccgcaatatgacgacgagtagtgaatagcctcttggtatttgatactgccgaggtgagcacggactacctgcaacgccaatcatgttgggaataatatcaattattaaggataagaaatgaaagcggcaacagcagtcatcgaccgccatgctctgcgacataacttacaacaaattcggcgtctggcaccgcaaagccggttggtggctgttgtgaaagcaaatgcttatggccacgggttattagccgcagcacacacattacaggatgctgattgttatggcgtggcccgtattagcgaggcgctgatgttgcgagcgggtggaatagttaaacctattttgctgctggaagggttctttgatgcagaagacctgccggtattggtggctaaccacattgaaaccgccgttcacagcctggaacagctcgtggcattggaagcggctacgctttctgcgccgattaatgcctggatgaaattggatacggggatgcaccgcctgggggttcgcccagatcaggccgaagcgttttatcagcgtttgagcgcatgccgtaacgtcatccagccggtcaatatcatgagtcactttagccgtgccgatgaacctgaagtggcggccacgcaacagcaactggcgtgttttgatgcgtttgctgcaggtaaacctgggaaacaatctatcgctgcttcgggcggtattctgcggtggccacaagcgcaccgtgattgggtgcgcccagggattgtgctgtatggggtttcgccgtttgatacgccctatggccgtgatttcggtttattgcccgccatgaccctgaaatccagtctgatcgcggtgcgtgaacataaagccggtgaatcggtcgggtatggcggcacctgggtcagtgagcgcgatacgcgtttaggtgtgatcgcgataggctatggtgatggctacccacgtagcgccccgtcagggacaccggtatggcttaatggccgtgaagtgagcatcgttggccgggtatcgatggacatgatctccattgatcttggcccggaaagtacagataaggtgggcgatgaagccctgatgtggggagccgaattaccggttgaacgcgtggctgcctgcaccggtatcagcgcgtatgaattgatcactaatctgacctcccgcgtagcgatggaatatctaggggaataaggtaagctgcaagagcgacccatttccatatacccgccatatttcaaattgcaggcgtgctggctgtctgcgtcccccttggtcacttactcatgtaagccctaggagggccgctccgttgccgcctttctgcaattcggatgattgcaggtatagaattattatcaatttaggagagcagcaccgtgttccagaatgttgacgcctacgcaggtgaccccatcctttcactgatggaaagttttaaagccgataaccgggcacataaggtgaatctgagtattgggctttattacaatgaacaaggtgaaatcccgcaaatgcaggctgtggatgctgccgaagcgcaattgagtgctcaacctcatgggacaccggtttatttaccgatggaaggtctgcaatcttaccgtactgctatccagcaattattatttggtcacgaccatccaatgctggttcagcaacgggtggcgacaatacagacggtgggcggttctggtgcgttgaaagtcggggctgatttccttaatcactatttccctgattcacaggtgtgggtcagcgatcctacctgggaaaaccacgtggctatttttagcggcgcaggttttaaagtgaacacctatccgtatttcgacaatgataagctggcggtgaagtttgacccgatgctggcaaccttgcagcaattgcccgccagaagcatcgtgttgttacatccttgctgccacaatccaaccggttctgatctgaccaatgcccaatgggatcgcctcattgatgtggtaaaagagcgtgaactgatcccgttcctggatatagcgtaccaaggctttggggcagggctgaatgaagatgcttatgctatccgcgctatggccgcagctggattgccatgcctcatcagcaactccttctcaaaaatcttctcgctctataacgagcgggtcggtggtttatctgtggtgtgtgaaagtgacgaggccgcagggcgtgtattgggccaattgaaagcgacagtgcgccgtaactattccagcccgccaaactttggtgcgcaggtcgtttcgaaagtcctaaatgatacggtattgcgcgcgcaatggcaggcagaggtggaacagatgcgcctacggatccttgatatgcgccacacgctggtggaagccttaaaagcctcgttaccagagcgcaattttgattatctgttgcaacaacgcggcatgttcagctacaccggctttagtgaggcacaggtagatcgcttacgtgaagagtttggtgtgtatctgattgcgagcggaagaatgtgtatggcgggagtcaatcaccagaatgttgagcaggttgcggttgcttttgcggcggtacagtaatgttcagcctttaaccgcgggcaaacgggtggccacaataaaataagcaggcagtaagatattgatatcgcccatggaagggccgctatatttttacggcttgccggttcccgccgtcgcgggtacttggtcaataacctcaaatcgatactttttattttttaaactcgtttctgcgaattagtctcttattctccctgtttggcccccagttgatggctgtctattgattacaaaatatactgataagtggggatgatatatgccatattaccctctattgatcacagtaaattctttatacccaaaataattcgagtttcaggaaggcggccactgagggcgttctcaggaacttacagaggtaagtgactgggggaacgaagtcagccaacgcacatgcaacttgaggtataacggggatatatggccgcaagttcgccttcagcgtatagcggcatccgatgaaataaacttttatgcatcttttagctgcatggcgtagcttattacaggagataactcaatgaatcattcggcattattggaatactgcctatctaaaccgggggcagagcagtgcgaacatgagcaatggcagacgaatcaaataaaagtcgccgatgtgatgtttgcaatggtggggaatattggagggcggccatcgatttcactgaaaagcagccccaaattggcagaacgtttacgggagcagcacccagagattgtaccgagtgagcacttgaataaaacgcactggaacacggtgtttctggatggaaagttacctaattcacagttttatacgctgatcgaccattcttaccaattggtcttacaaggattaccggagcagaggcggcaggatctgtcttcccatctgtaacgtcaatgattttagggatgaatagtttgatgatcaaaacgctgaatgtcataccctctggagcaatacattgattgccccagagtggttcattaaacggtttgtggcttacgctgcaacatcggcttaaggaaccgtgccgtgtgtgatgccgcgcattccgccaccgtctctggtgtgccggaaaccaaaatttcaccgccaccactgccgccttctggccccagatcgacaatccaatccgccgtcttaattacgtccagattgtgttcaatcactacaatggtattgccctgatcccgtaactgatgcaataccgctagcagttgctgaatatcggcaaaatgcaggccggtagtaggctcatccagaatatacaatgtctggccggtcccgcgttttgacagttcgcgcgatagtttcacccgctgtgcttccccaccagataacgttgtggctgattggcccagacaaatataggacaggccaacatctattagggtttgcagcttacgtgccagagcaggtacggcatcaaagaactcgcgggcctcttcaatagtcatcgccagaacttcgtgaatacttttacctttatattttatttccagcgtttcacggttataacgcttacctttacagtgatcgcaaggaacataaatatcaggcagaaagtgcatttctactttaattaccccatcgccctggcaggcttcacagcgcccacctttgacgttaaaactgaaacggcctggcgtataaccgcgggtgcgtgattccggcactccggcaaataactcgcgaatgggggtaaagatgccggtataggtggctgggttagaacgcggcgtacggccaatcgggctttgatcaatgtcgatgactttatcgaaatgttctagcccttggatctcgcggtatggtgcgggttcggtgatggtcgcgccgttcagttggcgttgggcaatactgtataaagtatcgttgatcagcgtcgatttccccgagccggagaccccggtgatgcaactgaatagcccgacaggcagcgtcagagtgacatctttcaggttattgcccgtagcccctatcagctttaagactttgctcggatcagcactgacccgtttctctgggatggcgatgctccgcttaccgctgaggaactggcccgtgagtgacgccggtgcggccatgatgtcatctaccgttccttcggcgacaacttcacctccgtgcacgccggccccagggccgatatcaatcacatgatctgcggcccggatggcatcttcatcatgttccaccacaatcacggtgttacccagattacgtaggtgaatcaatgtctccagcaagcgttcgttatcgcgctgatgtaaaccgatagacggctcatccagcacatacataacgccgaccaaacccgcgccaatctggctagccagacggatacgctgtgcttcgccaccggacagggtttcggcagatcgggataaagacagataattcagcccgacgttaaccaggaatttcagcctatcgccaatttctttcagtatcttttcagcgatttgtgcacgctgaccactgagcttcatattctggaagaaactcagtgcatggccgatgctcagttcagaaatctctggcagggtggtgttttccacgaagacataacgagcctctctgcgcagacgggtaccgctgcatgacgcacaggagcggttgctgataaatttggctaactcttcgcgcaccgcactggattccgtctctttataacggcgttccatattgtgcaacaccccctcaaaagggtggcggcgaacggtagtatcaccgcgatcattaatgtacttgaactcgatggtatctttgcctgaaccgtatagcacggcttgctggacggcgctgtccagtgagttaaacggcgcttcgatatcaaatttataatgctcggccagtgaacgtagcatctggaagtaatagaagttacggcgatcccagccgcgaatcgctccgccagctaaagagagctcagggttttgcagcacgcggtctggatcaaaaaactgctggacacccaagccatcacacgttgggcaggcacccgccgggttgttaaaggagaacaggcgtggttccaactctctcatgctgtaaccgcaaatcgggcaggcaaagttagcggaaaataataactcctccacatgcggatcgtccatatcggctaccacggcggtaccgccggataacgccaatgcggtttcaaatgattctgccaaacgttgcgccagatcttcgcgtaccttgaaacggtcaaccaccacttcaatggtgtgtttcttttgcagctctaatttgggcggatcagacagatcacaaacctcgccatcgatccgcgcccggatgtaaccttgagcggccagattttccagtattttagtgtgttcacctttgcgatcttttaccaccggtgccaacagcatcagacggcggccttccggctggcttatcacgttatcaaccatttggctgactgtttgcgccgctaatgggacatcatgatcagggcagcgcggctcgccgactcgagcgaacagcaagcgcaggtaatcatggatttcagtgatagtaccgacagttgaccgtgggttatgggaggttgatttttgctcgatagagatagccggagacaggccttcaatatggtcaacatccggtttttccatcagcgacagaaattggcgtgcataggcggagagagactcaacataacggcgttgaccttcggcatacaaggtatcaaaagccagtgaggatttgcctgaacctgataggccggtgacaacaatcagtttgtcgcgcgggataatcaggttgatattcttaagattgtgggtgcgagcgccccgaacttcaatattatccattcaaactcttcccggattgaactgagcctctcagcgtgcctttttttactcttcgtacttgaagctgcagggttgttagctgcgctcactcacccgaatcacttactaatgtaagttcatcgggatttgctcgctggctgcctacctgcaacgccaatgactttgagtatagttgcctgcttttcttaaaaacataagtgccatgagcaataaataggtacactttgcaacaccaaaaaaaggacaccgccagtacgaaacgggcaattatgacacaaaaaaacctgaatggatatccagtgtttggttgtaatttaggtagatgttgcgatagaactgcaatatatttcgcagttatgatcatccgtgttgtttaacagttagcgtgttaaacttactggtttatactttataaaatttatttcatcaggagagttcacatggccagcagaggcgtaaacaaagtgattttggtcgggaatttgggccaagacccggaagtccgctatatgccgaacggcggcgctgttgccaatatcaccctggccacatctgaaagctggcgtgataagcaaaccggcgagcaaaaagaaaaaacagaatggcaccgcgtggtgttgttcggaaaacttgccgaagtggctggtgaatatctgcgtaaaggctctcaggtttatattgaaggcgcactgcaaacccgtaagtggcaagatcaaagtggccaagaacgttacaccacagaagttgtggttaacgtcggtggtaccatgcaaatgctagggggccgtcagggcggtggtgctcctgcagggggtggcgcagcgccacaagacggcggggcacaaggcggttggggtcaacctcagcagcctcagggtggcaatcaattcagtggcggtcaggcttcacgtccggcgcagcctgcgccagccgcaccacaaggcggtaacgagccaccaatggatttcgacgacgacatcccgttctaaggctagttttaaacgtcagattagtcttagacgtcagattagttttagacgtcagattagctttaaacggccgcgccacggatggcgcggttctagtattcaggaatgctctttttatgcaggggaaatggtgtctttactggttgctgttctctccgtggcgggcgcttcgtcattaacgttgttatttctgttccaggcaagaaacttcatttcaggcaagaaacttcatttcaggtaaaacatttcattccagataaaatacttcgcgcagagcctgactcacagggctgttatccgggtggcttggcatgacatcagccatatgttgccaccagcgttgacactcggcggtttgagccaccgcattccagcgttcttctgattcaatttcgacaacgccaaacagtaaattgcgagtctcatcaaggaaaatggaatagtggtgagcgccatgcgctttcagcacgctttccagctctggccagattggcgtgtgccgtcgctgatattcagcatgggcatccggatttactgccataacaaacgctttacgtatcatcatattccctcgcttaaagtgcctgtaagtacagtgtgcgaatttgttcccgatctgcagaacgtgggttacaaggagcacaagggtcagccagcgctttatctaaccaaccttcaatatcactttcctcaatacctaaggcggagaacccggcaggaataccaacttgcagcgataactgacgaatggccgctatcgcctgatgacttgcttgctcatcactcatgtcctgagtgtctacccccattgcctgtgcaattcgggcaaaacggcgggtagcctgcgggcgattatattcttcaattaccggcagcaagatagcattgcagacgccatgaggaagattatgtgtggcacccggttggtgggccagtgcgtgaaccaaacctagcccagcactgttaaacgccatacccgccaaatattgcccacatgccatcatttcgcgcgcttgtaggtttttgccgtcagcgaccgctaatggcaaccattggctgataagacggattgattcgagcgctgaatggtccgttaacgtatgtgcacctaacgagacatacgcttcgatagcgtgggtaagggcatccatccccgtcgccgccgtgacactggcgggaatattgagcattactgagggatcgtcaaccgcaatatcagggatgagattggtatcgataatcacctccttcacttgccgctggctatcaataatcaccgcattactggtcaattccgccgccgttcctgccgtggtattgatggctatcaacggaacacccgtttgtttgactttacctacaccggaataagcggtggatggccccggattggcagtcagtattttgatggctttggcggtatcaatggggctgccaccaccgaaggcaatcaaatagtcacattgatgctgggtaaaggcggcaaaaccggcctggaccaactcttctgttggattagggaatacctccccaaacagcccgtaaggtaactgatactgcgccagcgccgcgaataaactgtccaataagccgagttcaaccagttgcccgtcagtaacaatcagtgctttcccccactgtttgtcactgagtaatttaaccatatcgccgattgcacccgtgccgtgcaagctgattttcggtagtgccaacatgaaactcatactgtactcctcaaataacgcataaatgattcgccccgacgttagccagggctttaatcgaggggattaggcgtccagcgccgctgccatcggcgtaacatcaaaacgagccgccagcgcgatcagttgttcacgtgaaatggtctgttttttgccgcccatcgacaggactttcaccatgatttcggctgatttctcggcggtatcaatcaggccaaaggcgtcatccagtgtgggcccgctgccaaaaataccgtggaaaggccaaagcaccaggctgtgttcacgcatttgctccgccgtttgtgtaccgatcccatcggtgcccggcaccatccatggcacaatgccaatcccatcaggaaataccaccaaacattccgtactgccttcccataacaggcgcgtgaagctggcgttctccagtttttgtacataactcagggcaatcagattggtggcatggcagtgcataatgacccggttggtgccgccgctgacctgcatcctgacgatgtgagattggaagtgtgcggccagctccgaggtgggtaaccctccctgagttaggccccagtgaatgtcataagccatgccatcattgctgacttgtagcaacaccagattttccgctgggttcaattcaacattgcggaaaaacttgccggaaccggtgacaaggaaccagctatttgccagttcgggagccggttgcgtgagctccactttacggggttgttggtaaaaatcacgacgataaggttcaacctcttcagcgagcagtcgcaagctgatattgccgccgttacgttcatcccaccctttgtgccacatatcactggtggctttaatcattccctgaataaaccaggaagatagaatagcttgcataattacgagtccttaacgttggctgagaatctgttgttcatattcacgtactgcgtcaagccagcgggcatcaaccggtacgtcattgcgctggcagtaaccttcccagatggcttgccatggcagggatttttgttcttccagcagcgccagccgtgcagtgtaatccccgcgtaattccagttgacgtagcatgtcggtcggctccagtaaggcgcgtaacagggcctttttcatgttgcgggtgccaataacccaagcggcaatccggttaatggaggcatcaaagaagtcgaggccgatgtgaacccgatcaaacaggttgtgacgaataatttcgctggcgatggcttgggtttcatcatccagtaacaccacatggtcactgtcccagcgaaccggacggctgacatgcaatagcaggcgtgggacatacagcatggcgctggatattttgtcggaaatcacctcggttggatggaagtgacccgcatccagacacagcgccgtttggcgactggcggcatagcccatataaaactcgttagagcccacggtgtaactttcagcaccaataccaaacaatttgctctcaaccgcatcaatatggtgagccgggtttaacttctcgctgatgacttcatccagagccgatagcaggcgctgacggggggcaaggcgatcaatcggcgtgtctttcatgccatcggggatccagatattcatgaccgacggcgttcctaactgttcaccaaaataggcagaaacccggcgactcgcctgacagtgttcaatccagaactggcggatttccggatcagcatgagacaaggtaaagccgtcagcgctgagcgggtgagagaagcaagaggggttaaaatccagccccaactggtgttttttggcccatgtaacccagtgactaaagtggcgcggctcaattttattgcgcgcaaccggcgtgtcagattccagataaatagcatgtaaattgagtcgcttagggccaggaattaatgccaaagccaattcaaggtcagaacgcaactcggtcgcattgcgcgctttgccggggtagtttcctgttgcctgaattccgccggtcaatacgccatcgggatcctcaaaaccggtgacatcatcgccttgccagcagtgcatggagaccggtagcgtatcaagacgggtgagtgcggcatcaacatcaacgccgacagcggcaaaacgctgtttagccagatcccaggcctgttcaatagagttcgtcatatgcaaagttccttaggtaattgactcagtgactggaattgcagccaatgggcagcaaagtccgagttgtcgtgaggggataaatggtgcaatgggaagttattcgccacgatacggcggtaatgggtgacatcagcgacctcacccagcgagattaattggctaccaatattgccgagcgtggaggcctcaaccggccccatgctgacatttaagccacaggcatcggcacacagttgattcagaaattggttttgacagccgccaccgacgatatgtaaatggctgattgggcgtccgcggagtgttgccaattcttgagccacttgccggtacaacatggcgaggctatcaaagatacaacgggccaactgggcggctgtgttcggcacggggaactgatgttcacggcaggcgttttggatctcacggcacatattgggtggattaataaaacggctgtcattgggattgatcagcgagcggcaagcgggttgtcgtgccgcttgctcaataagctgcggtaaatcgtcaatctgcaattcatccgtcgcccgttgcagtagccacagacccataatatttttgagtacgcggtagcggccttcagcgcccccttcgttggtgatattgctgcactgcgcctgctggtgggtgagtggtgtaccgctttcgaagcccataagtgaccaggtaccggagctaagataggcagcatcagcatcaataagcggggcggcaagaaccgcgctagccgtgtcatgggtggcaacggccaccaccggaacctgctgaccgttggcgctgtgccaatagccgatggtattgccaggtttgccgggtttggcaaaccaatgggccggtacgccggcataggccagtaaatcgctatcccaatcgccggtttcgatgttgagcaactgggtagtactggcattggtatattcccagtttagctggccggtaaggcggtaatgcaaatagtctgggatcaataataggtgggcaacatcggcgagtaagtgaggttgttgttcacttaatgcccgcagttgatacagcgtattgaacggcaagaactgaataccggtgcggcgataaatcgcattgctacccagcgtctgctgcgcccgcgccatcactccctgagtacgactatcacggtaagatacgggctgtccgatccgtttcccttgcttatcaagcaaaacaaaatcaactccccagctatcaataccgatgctgtccagcgctatcccttcactgtcgagttggctcagtccctcacggatagattgttcaatggcatcgatatcccagacatcggagccatcaatagatttaatctggttggtaaagcggcagacttcccgcaacgtaagctgttgctgaccgggataataacttgccagcatcacccgtccgctggacgcgccaaggtcaatagcaaccatgtgccgtgcagcttttggcgatgtgactgccgatggtgagcatgtagatggcgaacatgtagatggtgtgggcatgataagcggcctgttgtttctcaatgccaacagtgtagaaatttgcctgttcgacgaccttctcatcactgccaaccgctatggcttgatggcagaatgacgaaagtgaaagtgaaacagctcacagtttcgtatttaggcggcagcccattcccctgtgaccccgcgcatacttttcaacattgtcatgcctatctaaaaaaaatcgctgccaaagtggtttttaatgtcaaaaattgaaggtttagtcatcactgctgcttttactatcgaggactgaagcagggcgatttcgccgtgcctgtcgaaagagggcaaaagatgactgtattgcacagtattgattttttctcttccagctcagcacctgtggcgattgaagcgcgtgcgccgcaatcggcatttcctgagcatcatcatgatttttatgaaattgttattgtagaagagggggctggcgtacatgtttttaatggcaatccctacacattaagtcgcggttgcgtctgttttgtccgtgaccatgatcgccatttgtttgaatccacggatgatctgttcctcaccaacgtattgtttcgtgccccagatgcctttcgctttttatctggtgtcgggcacttcctgcctcgagaatgtgatggggtctatccctcccattggcgggttaacggccaggttttacagcaaataaagtgcttgattgcttgtctggaacacgccccgaaaagtgatcgggttgaggatatcgctctgcatgaaagtgtttttatgcagctattggtgaaactgtggcaagggtgtcagacgcaggcgggggatgatcaggaagggcggttataccaactgttggattggctacaaaataactatagcgaggcggttgaatggccggaattggcagatcgctttgcattgccattgcgtactctacatcgccagttaaaaaataagaccgggatgacgccccaacgctatctgacacgtttgcgcttactgcaagcccgtcatcaactgtgttacagcgacaatagcgtcactgacattgcttatctgtgtggttttggcgacagcaaccacttctcaactttatttaagcgcgagttttcacagtctccccgtgatttgcgtagccagctttagccgcttgaattgccctgcaagaaagggcgtgaagggtattacggtaaaaattgaagggtatcacggtaaaaattggccgtttcaagataatgaacaagtcattaattaacctataacgataaggctgcacacatgcgggcaccactgctgttagaaagccgggattatttactctcggaacagatgccggtggcggtaaccaatcgatacccgcaggaaaccttcgtagagcatacccatcaattttgtgaaattgtgattgtctggcggggaaatggcttacatgtcctgaatgaccacccttatcgcattacctgtggggacgttttttatattcaagccgcagaccatcatagctacgaatccgtacatgatttggtattagataatattatctattgcccagagcgactccacctgaatgcgcaatggcataagttactgccgcctttgggacctgaacagaatcagggctattggcggttaacgacacaaggcatggcgcaggcacggcccatcattcaacagttggcgcaggaatcgcgcaagacggattcctggtcgatacaactgactgaagtcctgttattgcaacttgccattgtgctgaaacgccatcgctatagagctgaacacgctcacttactgcccgatggcgagcagcttgatttaatcatgtctgcgttgcagcaaagtctgggagcctattttgatatggctgatttctgccataaaaatcagttggttgaacgttctctcaagcaactgttccgccagcagaccggcatgagtatcagccactacctacgccagattcgcttgtgtcatgccaagtgtttattacgcggcagtgagcatcgtatcagtgatatcgccgctcgctgtgggtttgaggacagtaactatttctcggctgtttttacccgtgaagccggtatgaccccacgagattatcgccagcgctttatccgctccccggtattacccgctaaaaatgaaccgtgataaccacagcgatctcatttagcattattcttcaccacgattagccataagataacgggcaggtttttcaacgctgcccgtcaatatcatcatctttaataatagatagtacttagcaataatagatagtacgtagcgataacagatattacgcagccatacccaaaccaacaatattcgcagccagaataatcaccagacaaccaatacacagcacggcaacaggctttttggttgaacatttccactctttgagtagcaggccgacaataccgccacacaatacatagaagctcatatgcagcatccagctcatataatcatactgttgtgggatcttggcgtggccccaagcatagaagaagaattgcagataccacatcaaaccggctaatgccgagaacagaatgttggtgatcagcagtggcttggcaaccgagaagtcggctttgactgacaagtttttaagtgttgccaaccggataaaacaatagctgaggttgatgatcgccccgcctcccataattatgacgtagcttggtagggcgacatacagtgagttgatccctaatgcgctggcggcttcatgcatcggttttgcggcatccatagcaaatgacataccggcggagaaaataccgcacatcacggccaatattagcccctttttcaggttgaactcttccgcctgaatgcccattgcccgttctttcagtaacccggcataactgacgatggcaacaccgatcagggcgacgaacacccctaaaagggtcattcgcccaccgggggtaccgaggagcacatcaaaacgcccttgcagaataggggtcatcaacgtgccgataatgagtgtgataccgatggctatccctattcccatcgacatcccaaggtaacgcatggtcaggccatagttgatgttacctatcccccacatagcgccgaatagaaataccggcagtaaggtagcgatgctgaaggaaccgtaatattgccaaaaatcaggtaataacagatagctgaccgtccatggaaggataagccaggagaccaaccccccaatagaccacatggtttcccatgaccatttcttaacttgtttaaacggcgcgtagaaacacgcggcactggcagcaccgaccagatgccaaattatccccaatataatcgcattattcatcttattatccttcgctgtgatggtgcgggtaggcgcagaacatgaagggcgcacaaaccgctgatgacgaaggagtctaaatagtgtgcagccttgtcaccttcggctgactgccttaggacaaggaaaactggcaaaattcagtaggtaagaatgatgatgatcacaaaatggcattctggtggcagattgacgggttttatggcattaacggcagtcagtcagcaaaaattgcgctgcccttgctcatccctgtcacttagtgttgttgatcttaaaataagtagtgttgttgatcttaaaataaatagtgttgttgaccttaaaataaataagcgcctggggattaatgagcttccccatttgaacagaatcaatgctgttcaaaagggttcccgcctactggcatctcgaagtaacttaggtataagcctattaagttagaggtgatttaatttatgtactggcctatactttcggaccgtgcacgaatgaaacttgtcgtgaattactggtgctgcttacgcccttcaatatcggtatgatcacccgcgatgactggggtagctatgctaggctcgtaccgcaagatagccatctgactggcaaaatctttactcagcgcattgaacgcaacaacctgactttacgtacatacatcaaaaggctcgcgcgcaaaactatctgcttctcacgctctactgagctacatgaaaaagttatcgaaacctgcattgaaaaatacatgttctactcattggaggtatcacccaaaaaatcagacaaattgaatctttttagtcgaatatggctttagaaataacaaaacccgcacattggcgggttcgttgacattaaaaggaaacattcactttaatgtcaatgcacggtaaatttatgtttttttctatccgggccaaagcacgaactttccgagatacacgttgagaatccaaccagagcatttgctgtaagtgccctcacaaaactattattagtccagacatccggagcgtaataaactctgatacgcttaccggttgtataataatacatagcctgatcatataacgtgttatatgatgctccccatatggaggtgtcctttactgaacaggctgttatcgttgttgacggcttgaatgcctcaatgcagaaataaggtttcccatcaacctggcctgaatgaaatttatttataatcatgcctgaatgcataccttctacgttatcaccagtccattcagcaaatgcaggattaagagagacgataagaaaaacagacagagataataaataacgcatactttaccctccaatgacacatgaaaaaatactgttctattattttactcattaatttcgttgtaaagttatttttagcacaaaatgatgaaattgtaatgattcaataagacccgacaccttgttgtttatataattagcaatattaacgaggtgagagtgaaacgacatacctttacctccgcgtttaaactggaataagtcagatcaagtctgatctactacactcatggctacgttcagtgatggcagtttttttattgacaacaagacgccttattttaatttgttaattatgggtgagttattaattatatatgaagtgctagatatatttcaaaataattttttatatgtaaatatcactaatgaattacattggggctttaatctataagttatgtaattttagtgagggttatatttatgagacaagtaacgaaatcaaagaaaattaaaatcttgccatacccagaatggttagttaaggccgggatgtcaaaaggtatagatcatgataggcaacatttaggcattattcttgctgcaggtgaaatgattaaagtcagacaagtcaatgctgaatataaggaaaaacttaaattatatttactcaatgataataaaaatactcaacgatcgataagttttaatactgattggatagagctgagtgtcgatgctgtttcagtaccctttattaataccccatatagtgatgggattattcctgagattatttttgagtatccggatacttctaaattactgccagtttatgaaaaaggagaggatgagagcatcttctttgaaagttgggataaacagaatgccgagtttggcgtggtagaatcagaatatgtaataattctgatcccggaagttagtaaggacaggctaaaatctttcagtacgagtggcggtattgatacagttttggggttttatcaagatattttttctttcaataattctctggctggcttgtcttttgaaccgcaaagatattctgacggaaacacacgaaatcgttactttgctaaagcagataaagggggcggtggggcagcatattattctaataattggattgcctcatcctctggttctataaatacattttggctttctcccaatgctactaactggggctgcctacatgaaattgcgcatggttatcagggcgggtttattgatgataaatatttttccacaagagaagtatggaataatatttatgctgcctgctaccaagatgttatgttaggtgctgaaaagtttaataaagggtggctatataatttcggtaagcaaaaagaggttgaaaaaagtattttaaataacattaataatggtaaagaagtaaatgcttggggggaacgtagcaaattatattttatcatgctgatgctggaaaaagcgggggtaaattgttttactcatttcaaccagatatatcgtgagcgtaaaaatactgatcaaagcgtaggctcggtgttagatatgctctcaaatagtttcgcaactgttgaaaatcgagttgatgttacaccatttttacaaatggttgggggacatatatctaaaaatcaatatcaacgtaacttatttagccatgcaaaggcggtatatccattaaatcaactcttgcaaggtgatgaactcactgctgttaagaaaacgctagatttgaatagtgaactcagtcttgttgatgtggatagtattgaatttacagatataaaaagtaatttgacattgcaattttctatagatgatttcgctcagatatatggcgaagaattgcttatactgaatggtgacaactatgtgtataatcaatctattatggataaaaaacaaactttatataatctccccgttggtgcttatacattgcgaattccaacaggaagaaataaaaaatatgcatcacaaattaattatctgatagtgaaaaatgaagatagccaaacacaagttgattttgtccacagaataggatctccaattgtttcacaaaaaatttctttgcagggactaaatgattatacatttgcaactatattttttgatcaagaaaatgatactgtcagcgttgatattactaagactaaaccacattatcatttccctggcatgtatgcgagaataagaataaaagacaaagataataatgagctactcaatgaagttattacaggaactaatcaatcgctgagtaaaaatgattttccactatcttcttgttatgttattgatatctttcacaaagagcctggtagggtaaagctaactccggcatataaaggtgtgattgataataaatccagttacaatgaatttattatcacgccttatggtttgcaaaacatcaaattgaataatgatccaaaggtttttttattggaaaatataaaatcggcagcagaaacgctgcgtagtcaccctataatgtggcatgcgaatttttcagaagctaaagataatatatatttggcaatcgatgtctttcctagcccacaaaaggaaggtttactagagcaatatgctgattgtatttcttcctactatgaaaagccaaatgaagacttgggtaatgcatttagttttatctttaaaggaattaatgaccgagaatttttgacaactaagcttaatttagtgacaaaaaaacttgaagttaaaattgtaagtggtactccacatagtggattcaacaggacttacgctgtactacgttattttaatgctgatggaaatgaactccttaatctggatattattggtagtaaaaaacaggctggacaagagtgggtattccctatatcaggttatggtggagaaaaactctatcttcaacatgtggaacctaaaaatagattagtgattaccaatattatgcaaggaatcagattatcatcgcgcacaagcatacaaacctatgaaatagaatctttggggttgagtcgttgcacctgaccctaagcgacatttctcatcgcacaagccacaaccgtcgatatggcagatttacgttggccttaatggggagctgcgatgagtttcattgtgtttaaatcagttatgcccttgtgttgtctggtgatagctgcgtttacgtcacgatcatgttcaacaccatgcgcatagtataatctaaggcaaacgatacaacccgaatcacctccgtcatttactgaccagatatgttcaccattgaggtttgtatttatcgctctgaagacgattaccaaaggtttatctgcaagggtaatcctccgattttcaacggaggtcttgaatagaatcaggcaacctgtttaatatgttgcatcggcggggaattggaccggaaatagaccagaatccagatacgaaaaagccccgctttgcagcgaggccttataaataatggtgcccggactcggaatcgaaccaaggacacggggattttcaatcccctgctctaccgactgagctatccgggcaacggggcgcattaaaccgtattggctgctgatcgtcaacgaatttataacctaaaaccgctaaaactatgttgatcgctctcttttcaggcaaaagcaggaaaaatcgcccggcgcttgccgtaaagtttacgctagaaagactcagcttaaggcaccatttttacggcattgggccactgttaatatgtcttccgctaaacatttggcaacctcaacatctgccaactgacgcttaatcagtaatttgctcaggcaaccctccagaatcaactccatctgctgtgcgaccatatcggcatcgtcagcatccatctcttgcagcaaggcttttgtatagtgcagcgaggcctgtttctgctgttcagccaattggtgaatagggtgctcagtatcaggatagaaactgcaggcagcaataaacaagcagccggggtagcgctggttttgcacttgctcgctcagtgtttgatagcgtgccagtagcttttgctgcggtgatagggtctcgtccagctgtagctgccgccgccaggtatcaatctgttggctgtgatagcgcaggcaatcgtagagcaatgcctcacgatctggccaaaagcgtgtcaggtcactgacttcaactgacagcgctttggcgagcatttctagcgtggtatttgccaacccttgctgttctaacagattgagtgcgttacttaaaacttgttcacgttgcacgttactctcctccaacctctttatctggcaagtgtggttgaccgctgcttattctgcaaatgacccattttttgccaatagccctatctttacgggcaccccgttgtcggttgacgttgtaccttaccacgagtgcggtgggattttcctatcatcagggggagaaagccaatctctgcaatattctctccagaacctcatttgggtatttatctaagaggctcaccctttttatcgatttgcattggcggccatgttcgctctagcaattatattctttcgctctaaaaattaattgtaatgaaacaacactataaccattatgtttataaggttaattatgggataagcattgtgacgagttgttgcaaataataactatttatccggcaatggcatgacttctgggaagaaatataatgaatccatttattgttgctgacgctgagagctgtattggttgtcggagttgtgaagtggcttgtgtggtcgcccatcatgagggccagtttcctgataaaccggaatatttcaccccacgggtgaaagtattcaaaggcgatcaatgtgcgacggcagtattttgccatcattgtgaagatgccccttgtgccagcacctgcccgaatggtgccattgttgaattgaataatagtattcaggtgattcaggaaaaatgtattggctgtaaaacctgtatgatcgcctgcccgtttggcatgatgaccgtggtcaccgaaacggttcaacccgccagccaccgcttagcggatgtctatcggcgtacagaagcacaaaaatgtgacctttgtcttgatcagcctgatggcccagcctgtattaaaacctgccctacgcaggctctgaccttggtggaccaacaatatttactgcatcaacagcagcaaaagcgccaacacatggcgctgaatgagcacaatggccgcttgttcagtcgcgcggtggtacaggcggccagtgcatcgtcaaataaaagcatccgcgacgcaacaccggttaacctcttgcagcggccacgggcaccacgtctggagccgaaaaaaattccgttggcagagcgtaaaacgggttttgctgaaatctatctgccatttaccgaaagccaaatccatgaacaggctgaacgctgcctggaatgcggtgataaaaccatctgtcagtggacatgcccactgcataacgccatcccgaaatggatctcgctggcccatcaggggcggatccatgaagcagcagaattatcccatcaaaccagcagcttgcccgaagtgtgtggccgggtatgcccgcaagatcgcttatgtgagcagtcctgtacgctgaatgaccacgatggcgcggtcactatcgggcagattgagcggcatatcacggaaacggcactggcgaccggctggcggcctgatctgtcacaggtgaaacccagcggtaaacgggtcgctattattggcgctggcccagcaggtttgggctgtgcggatattctggtacgtaatggcatcacgccagtggtgtttgatcgttatcccgaaattggcggtttgctgacatttggtattccggctttcaagctggaaaaatcggtgatgactcggcggagagaaattttcaccgagatgggcgtggagttttgcctgaatacagaaattggccgcgatatcaccatggaaaacctgctccacgacttcgatgctctgttcctcggggttgggacctaccgttccatgcgctcaggattagaaaatgaggatgctcagggcgtttacgatgccttgccattcctgatcggtaacacccagcatttgatgggttacaccgccaatggcgctcacccttatgtcagtatgcaggaccaacgcgtggtggtgttggggggcggtgataccgccatggattgtgttcgaacctccctgcgtcagggggcaagccgcgtagtgtgcgcgtatcggcgtgatgagaagaatatgcctggttctaaacgtgaggtgaaaaatgcgcgtgaggagggggctgaatttatgttcaacctccagccgatgagcattgtggtcgatgaatcgggacaggtgacgggtatcaagatggttcgcactgaaatgggacaggcagatgcccaagggcggcgacaagccctgcctatcgccggttccgagcatcttattcctgctgatgccgtgatcatggcctttggtttcagcccgcaccggatgtcatggctggcagaacataacgtggtgctggataaacaggggcgcgtggttgcgccgactatctccggctatccctatcaaaccagtaatcccaaaatttttgccggtggcgacattgtgcgaggagctgacttgattgtgaccgccatcgcggaggggcgcaaagcggcagagagtattgcgtattatttgaacgttttataacgcctgcggccaggagagaaagatgaaccgttttgttatcgctgatatgactcagtgcattggctgccggacctgtgaaatcgcctgtgtggtggcgcatagcgcagataataaggtcagtacccttatgccggagcagtttcacccacgcctgagcgtcatgaaaagctttgcggtcagcacaccgatactctgccatcaatgtgaagatgcgccgtgcgaaaacgcctgcccaaacggggcgattatcacgggttcccatggcgtgcaactgctggcgtcgcggtgtatcggctgtaaaacctgcatgttggtgtgcccgtttggtgccatgagcattattgagcggccagccgatggtcaacaggcggcagacagtcaaccggtgatggcgagtggatcagggcgagcacaggcgcataaatgcgatttatgccatcagcgggaatccggcccagcttgtattgaggtctgcccgactaatgcattgaaactggtgacgccaggggtattggaagccctacagcgcgaaaaacagttgcgggccgcacgaggcagcgcaccgggtatcgcccgttaacctacgatcataaggataaaaaatgaaaaagatcctcacggtctgcccctattgcggctcgggatgtaagttaaatttattggtcgaagacggcgagattgtcggtgccgaacccgctgatggtgtcactaatcagggagcgttgtgtctgaaagggtactacggctgggattttcttaacgatacccgcttgttgacgccacggttgaccacgcccttattgcggcgtcagcgaggcgaggcgtttcagcccgtgagttgggaggcggcgattgcgtttatcacggctaaacttagcgccataaaagaacgtcatgggcctgatgccatcatgatgacgggctcttcccgtgggccaggtaacgaagccaattatgtgatgcaaaaatttgctcgtgcggcgatcggtaccaacaatattgattgctgcgcccgcctgtgccatggcccgtcagtggctggattgcagcaaacgctgggtaacggcgcgatgagcaactctatcggtgaaattgagaatactgactgcattttggtctttggttataacgcggcggattctcaccccattgttgccagacgtattctgaaagccaaaaataagggggctaaacttattgtctgtgatccacggcatatcgaaaccgcccgtatcgccgatcaatggttgccgctgaaaaatggtgccaacatggcgctggtcaatgcatttattcatgttctgattgaagaaaaactctacgacgcaaattatgtccgcgaccatacccgtggctttgatgaactgaaagcaggcgttgccgcataccgcccagaggatgttgaaccgattacggggctgtctgccaaagcggtgcgtcaggccatgcgcacttatgctgcggcccctgcggccacccttctatgggggatgggcgtgacccaatggggccaggcggttgatgtggtgaaagggctctcttcgttagcgttattaaccggtaatctggggcgaccaaatgtgggcgtcgggccagtacgaggtcagaataatgtacagggcgcgtgtgatatgggcgtgttgccgaataccttccccggctatgaaaaagtgaccgacagtgaggccagagcgcgttttgctcacgcctggggggtcgctgaactgcccgcgcatgttgggtattcgattaccgatgtgccgcataaagtggcagaagggaagcttaaggcctactacgtatttggtgaagatccaatccagaccgagccagatttagcggcgatgcgtgcggcttttgccgcactggatctggtcgtggtgcaggatatctttatgaccaaaacggcagaactggcggatgtcgtactgcctgcaacatcctggggggagcatgaaggggtctataccagtgctgaccgggggttccagcactttaataaagccattgaaccgaaaggggatgtgaaaccggactgggagattatcagcctgatatcaaccgccatgggttacccgatggcataccaaaatacgcaacaaatctgggatgagatgcgtggcctgtgcccgccattcgctggggccacctatgataaactggcaggattgggctacgtgcaatggccttgcccaaccgaagatcaccctggaacaccttatctctataccgataaccaattcgcgacggctgacggcaaaggtttgctcagttgcgcgccgtggcagccgcctcatgagcagaccgacagtgattatcctctggccctctgtaccgtgcgtgaagtggggcattacagttgccgctcaatgaccggtaactgcgccacgctaaaaatcttggcggatgagccgggctatgtgcaaatccatcctgaggatgccagctatttgggggttatcgatcaggcgctgatctggatttcatcacgacgcgggagagtgatcgctcgtgccagcgtgaccgaacgggctaatcgtggcgcggtgtatatgacctatcagtggtggattggggcctgtaatgaactgactgtggaccatgttgatcccgtgtcaaaaacaccggaatttaaacattgtgcggttaaggtcgaggcgattagcgatcaaactgcggcagagcaatatgttgagcaacaatacagccagttgaaaaaacggttatcagacgccgcagttgtaccatgacttgtcgtgattgagcgttgattatgccacggcgagacctactcgccgtggcgacagctatttattttgtaaccgcgggggtgttttgtaaatgctgtaagaattgcgcagcgtccataaacccggtgacccgtgcggcagtgatctcgttgccctgagaatcaaaaaacagaatagtgggtaaacctaacacgttaaatttattcaataatgtggcatgttcagcattgttggcggtgacatccgcttgcagcaacagggtattggctaactggcgctggaccttatcatcactgaaagtgtatttctcaaactctttacaggccacacaccagtctgcatacagatcgagcatcaccggtttaccctgcgcctgcgctaatacggcttgcaattggggtaaattagccactggttgaaagtttatatgcttgactgcgttctgctgcgtgttgccgttaaaggcccaatcttgcaaggggcgagccacgatcaacagtgcggccaagagcaataactggcagacccgcacccaaccagcgtgcgctttcaggctcaatacaaacgcccagccaaagaacgcgacggccagcaggctccataaacgtaaaccccagacatcccccagcaccctttccagtaaaaacacgggcagcgccaggatcacaaaaccaaaagcctctttgacatattgcatccacggaccgctgcgtggaatgagcttgttgccgaacagggtgacaaccactagcgggatccccatcccaagcgcatataggtacaaggtcccaccaccggccagcatattaccgctttgggcaatatagagcaggatcgcgctcagcggtgcggtagtgcagggagaacaaatcagacccgccagtgcacccatcgcaaatacaccggccagtgagccgccacgttggctattactccactgtgtcaggcgggtctgtaacgatgaaggtaattgcaatgaatacaggccgaacattgataatgccaacagcacgaataataccgacaagccaatcaacacataaggatgctgtagcgcggcctggaactgtaaacctgctgccgcaaccactaaccctagcaaggtataggtcagcgccatcccttgtacgtacaccaccgctaatatcagtattcgccgttggctgtgtggtttttcacggccaagaatgacggctgaaatcaatggatacatcggtaaaacacagggggtaaacgcaatcccgataccgattagcagcgcccacaagggagagaagggtaacgtagacggtactggtgtggcatcgccctctggctgtgttgtcgctggtggattgacggtagcggacgaattgacggcagcagtgcctgaagccgtggaagcagcaacgaccacatcaagtgggatcacccgcgtttctggtggataacagaagccggcttccgcacagccctgataggtcacactgacgctagcctgttcagccgcctgagtaatggggattttcagggttaactgctgcttgaaaatctcgacttcaccatagaactcatcatgatgcgtaatgccttccggcagggtgaatgctcccagagccgcttgctgcggtacaatttttatttgctggcgatacaggtagtaaccgggatggatttgccaactcagattcagctgatcgccttgctggtggaaatcaaaggcgaacgcttgatcgaccggaataaaccggctctgactgtttttggcaccaaaagaggtattctcaccaaagagtgaggactgggcgctgtgcggggcgagtaatacgctgcacagcagcaggatcagagtaatgaagcgttgagccatgacaggtaatctttatctccgtcccgtaccggtagcaccagtaattccggcgtctggtaggggtgatgttgtttgatataagtgagaagggcctgctgatggtcagtattgctcttgaacaagagctgaacctcatactcttgttcgagtttaccttcccagtaataaagtgaggtcgcccccggcaacaacgtgacacaggcggccagtttctcccccagaacctgcgcggctagattttgcgcgctggcttcatcgggggcggtgcacaataccacgatagcatttgaataagacactgcatttggatcagtcatagcatcagaatcagacatcttaacctcttcggtcgcgctgttttatgatggtgtcgagagcggcgtgataacgcgatatgttacgtaataagcttacaaatcatactataccccgaagccggggccagccagaagatgatttatgtaacggtgagagatagaccgaagttattggggcgcatgatgcgccccatcagacagattacagaaccagaccgcccatcacaaagccgaaacaaacggccagtgcaaccccgatggtgccagggataaagaacgggtggttaaacacaaagcgaccaatacgggtggtccctgtgtcatccatttgcaccgcagccaccagtgttgggtaggttggcaggatgaacaggccagaaactgccgcgaaagaggcaattgccgccaatggtgaaacgttcagcgccagcgccattggcattaatgccttggcggttgcagcttgagagtaaagcagggcggagcagaagaagaaaatcacagccagtaaccatgagtgcgcttgaatcaagctacccgcggtctctttaatccactcaaggttgtgttgtacaaaggtatcacccaaccaggccacacccaggatacagatacaagcgctcataccggctttgaaggtgctggagttcaagatcgaatccgtatcaaccgagcagaccagcgtggtgatggtagcgacactcagcatgatgatcaggatagcgttagtggtgttcatcagcggcgtttcaacgagcccaacacttgggctgttgatgatcgcataagccaccacacaaagtaccccagccaggaacagcagaacggaagttttcgcccgtggtttgatcacttttacggtgtcgccacgcagggtgactaaaccttcttccaaacgtttcaggtaaataggatcatcggacagcttggagctaaagcaccaagagacgatgagagacatcaccaatacggcacaaagggtggagggaataacgatcatcagcagatgtaaatagctgacaccctggccttccatgaccgaagacatatataccactgccgcagaaatcggggatgcggtaatggctatctgtgcggaaacgacagcggtagacagtgggcggcaaggtttgatgccctgttctttcgcgacttcggcaatgactggcagagctgacagcgaaatgttaccggtcccggcgaagatggtcagaaaataagtgaccagcggcgcaagaatggtgatgtgttttgggttcttacgcagtaacttttcagtttgctgcaccagataatccatcccccctgcaacttgcatcgcagagatagcggcaatcaccgccatgatgattgaaataacatcaaacgggatactgccgggtttgacaccaatgatcgccaataccagaacaccaattccgcctgcaaaacctataccaataccccctaacctggccccaagaaaaatggccagcagaacgatgactaattctacggctatcatagtgtttactccttgtttaaatttgaacgtaaaagttaaaaaattgtgtttgccagaaagtaaaaaggcacgctgtccagaggagcatgcgtgccttagagggctaccgaatatttacattattgttcattttcatcggtataacgtttcgctttataggctgggtgcatcaggttttcaacagagaaaatgtcgtccagttcggcttcagttaacaaaccgcgctccagaaccacttcccgcacatttttaccggtttccgcacagattttacccacaatgtcaccattatggtggccaatgaacgggttaagataagtgacgatgcctatggagttaaagacgtagcgctcgcagacctctttgttagcggtaatgccattgatgcacttctctaacaggttgtaacacgcattagtcaggatatggatagactcaaacatggcctgaccaatcaccggctccatcacgtttaactgaagctgacccgcttcagccgccatagtaatgcaagtatcgttgccgatcaccttaaaacaaacctgatttacaacttcagggatcaccgggttcacttttgcaggcatgatagaagagcccgcctgcaattctggcagattgatttcattcaaaccagtacgtgggccagatgagagcaaacgtaggtcgttacagattttggacatcttaacagctaggcgttttagggcgctgtgtaccatcacgtaagcgccgcaatcagaggtcgcttcgatcaaatcttcggcaggaacacaggctaatccactgatttctgccagtttctgcacggcaagttgtgaataaccttctggtgtattcagcgcagtgccgatggcagtggcacccaggttgacttccaatagcaactcggcggtccgttgcaggttcttggtttcttcattcaataacacctggaaagcgcggaattcctggcccagagtcatgggtacggcatcctgtaattgggtacggcccattttcagaattttctcgaattctttagattttctaccgaaaccttcgcctaattggttgatagcatcgatcaacttgaggatggaggcgtagaccgcaatgcggaaaccggttgggtaggcatcgttggtggactggcatttgttcagatggtcgttagggttaaggtactgatattcccctttttggtggcccatcagctccaggccaatattggccaagacctcgttggtgttcatattgagagaggtacctgcgccgccctggaacacatcaacggggaactgatccatacatttccctttatccagaacttcatcacatgcctgaataatgatgtctgcaattttacgcgggatggtatgcaactctttgttagccattgccgccgctttttttaccatgaccatgccacgtacaaattccggcacgtcactgattttactgttactgatatagaagttttcaatcgcacgcagggtatgaacaccgtagtaagcctctgcggggacttctcgtgtacctaacaggtcttcttcaatacgaatgttatttgacatgagaaccttctctatttgtgctgtcttgtattgtatttgttaactgatttatgctgctgtcagtaatatgatgcggtgatgcgcgatatgcacggaaatattaaccacccatcttattgctggcaggatgatatgctgcttagcaataaaaagccttgaactaagatcactatatgaccggaattaatcaagatgatctgatatctgtgattgctctcacacttagtttaatgagtaataaaacggttacctcggcttgaaaagtgctttgttcaccaccattttagtagagttgaccgatgttgaaggggggcgctgacgctaaaatccgcgaatagaggaaaatagccgtatcagtacctacagggtcaaggttttcatggtatctgtcagacaggctaatagcctgatgaggggtactgaatgattaaaaataaggagaatacggtgcgttggttaccgtttgcgctgatatttttattggcatatatagaaatatcgatattcatcaaggttgccgcagtattaggggtaccaatcaccctgctgctggtgatcattagctcctgtgtaggcatctcactggtacgtaatcagggcataaaaacctttatccagatgcaacaaaagctggcggcgggtgagagcccggcggctgagatgatcaaaagtgtttcactggtcttggccggtattttgttgctgatccccggcttcttcactgatttccttggcctgttgttgctattgccttgggttcaaaaaacattaacgctgaaattgatgccgcacttgaacatttatcgtggcggtagctttggcggtgctggctttggtaatggtggctttggtaacgatagctttggtaaccgccatggttctggcccaatgagtggcggggatacttttgatggcgagtttcagcgtaaagacgatgaccgttttacggtggagcaccgtccggataaaaatgagcaagtagcaaatagtcgttctaacgatgatagttttaaagatgataaataaaaaggagggtaattttctaatagcctgtttattaatcataaatttataaagtaaatcatagtgctttctttgtaccgtaggcgataggcggataaaattatctaccgccaggcgagaaaaaaatgaaatttttttggtcgcctcccttgaaggaataagaagtcgcccccacttagaaagccacggtatcggttatgaagtcataccggtattaatcttaatctgatacggaccttctcataggagagctatcaatgaaaattcgtccattgcatgaccgcgttatcgtcaagcgcaaagaagttgaatctaaatctgctggcggcatcgttctgactggcactgcagcgggtaaatctactcgtggcgaagtcctggcagtcggcaatggtcgcatcctggataacggtgaaatcaagccgttggatgtgaaagtcggcgacgtcgtgattttcaacgatggttacggcgtgaaggctgagaagatcgacaatgaagaagtgttgatcatgtccgaaagcgacattctggcaattgttgaagcgtaatcacgctctctaatcttctgaactgaacgagttaagggaaataccaatggcagctaaagacgtaaaattcggtaacgacgctcgcattaaaatgctacgcggcgtaaacatccttgctgatgcagtgaaagtgactctgggccctaaaggccgtaacgtagttctggataagtctttcggttctccaacgatcactaaagacggtgtttctgttgcacgtgaaatcgaactggaagacaagttcgagaacatgggcgcacagatggttaaagaagttgcctctaaagcgaatgacgctgcgggtgacggtaccacgactgcaacagtattggctcaatccatcatcactgaaggcctgaaagcagttgccgcaggcatgaacccaatggatctgaagcgcggcatcgacaaagccgttatcgcagcggtagaagagctgaaaaaactgtctgtaccttgctctgattccaaagcgattgctcaggtcggtaccatctctgcaaactccgactcaaccgttggcgaactgatcgctcaagcgatggaaaaagtcggtaaagaaggcgttatcaccgttgaagaaggttcaggcctgcaagacgagttggacgttgtagaaggtatgcagttcgatcgcggctacctgtctccttacttcatcaataaaccagaaactggctctattgaacttgaaagcccattcattctgttggctgacaagaaaatctctaacatccgtgaaatgctgccagttctggaagccgtagcgaaagccggcaagccactgctgatcattgcagaagacgttgaaggcgaagccctggcgactctggtagtgaacaccatgcgcggtatcgttaaagttgcagcggttaaagcacctggcttcggcgaccgtcgtaaagcgatgctgcaagacatcgcgaccctgactgcgggtactgttatctctgaagagatcggtctggaactggaaaaaaccactctggaagatctgggtcaggcgaaacgtgttgttatcaacaaagacaccaccatcattattgatggcgtaggcgatgaagcggcaatccaaggccgtgtggctcagattcgtcagcagattgaagatgccacttctgactacgacaaagaaaaactgcaagagcgtgttgctaaactggctggcggcgttgccgttatcaaagtgggcgccgcaactgaagttgaaatgaaagagaagaaagcacgcgttgaagatgctctgcacgcaactcgtgccgcagtagaagaaggcgtcgtagcgggtggtggtgttgcactgattcgtgcagctcacgctatcgctggcctgaaaggcgataacgaagaccagaacgtgggtattaaagtggctctgcgtgcgatggaatctccactgcgtcagatcgtggttaacgcgggtgaagaagcctctgttatcgcgaacaaagttaaagcgggtgaaggtagcttcggttacaacgcttatactgaagaatacggcgacatgatcgcgatgggtatcttggatccaactaaagtgacgcgttctgctctgcagtacgcagcctctattgctggtctgatgattaccaccgagtgcatggttactgacctgccacgtgatgacaaaggtgctgatatgggcgctggcggcatgggtggtatgggcggcatgggcggcatgatgtaatgctcccagcctttctgcggcctttggtgctttttgctaaaaagtagttaagggcagcgaaaggtaaagctgttgataaaagcgagtagggtgacctgctcgcttttattttgtgaagactgtaattaaaattgtgttaagcgctaaatctgttgcctctgatatcggtcataaccacgccacaactgagttctacactcaattctttctgacctacattttgcaatataacgtcctaaagcggctttattctattctgtgtgatgattgctggactttttttatctatcacgctgatttaatgtgtaaactgttataccctttatatttgctgttacagcagtgttagcggcgctcgttattcggtccatccatggacctcacctctgagaggccgctgcaaacagcgttcaaatctgctcttggcagatttgtcacccgaatcacttgttttttaaagttcatcggggggcttttgtttgctgtcttgctgcaacacctcttattgtaggtctatttctcagagccttgtgtctggacaacttcggcaacgggtgcctaagcggcagcggtgctttctggtaatctttagcgtgactctcaaacgtcgaatggggaaagaaatgcggattaatgtgctgttaagaagtcatattttactcaagagtaatgtcttactgaagattaagacattacttggcctttcagccgtactggtgttggcgggttgtagctcctctaacacattgagttcggcgggtgagcaagtgaagttttctgatactcagcctggcagtgagtgccagctagtcgggcaagtaaccggtactcaaagtaactggttatcaggtcagggcggggaaagcagctcaatgcgtggtgcagcaaatgacctgcgtaataaagcagcggcaatgggtggcaacgtcatctatggcgcaaccagcccgagtgaaaccttcttatcaagctttgcaccactagaaagtaaaatggttggtcaagtttataaatgcccttaattgctcaaatgtagtgggtatgagtggctgtgctttgttctacgttttttcatcgtaaacaaagcagggggatattaaggtatcccctcagactgctgacaacgttaattgaaggggaaacgtgccgttggggtcgtagtggcgtaagcagccggagtgcccccataggtgcggtcaatccttcattcacgaggctaaaaatagcgttgtcaataacctctcctgagttttatcgaatagagagtcgttgagatgagtccttgtgggtcttgcttgggcagtgattaattttgcgtcagtctcaaatccaatggtgtcttacttggctctccacccacttctcttgtgagacgcggtaccaggtaaccagatacacggcttagtaaacctttcatcaattgccgggcttcatcatcatcgaccataaagtgggctgcgccctgtactttatccaatacatgaatgtaataaggcaaaattccggcatcaaataaggcattgcttaatgttgccagtacatccgcatcattattcaccccacgcagtaatacactctggtttaatagcgtcacaccagcctgcttcaaccgtgccatactgtctcgcaggggcgggtctatttcgttggcatggttgatatgtgtcaccattaatacctgtaaccgtgagcttcccaaccgttgacacagggttgcagtaatacgggcagggatcaccaccggtaatcgggtatggatacgtaaccgccggatatgttttatatcctccaattgatccagtaaccaactgagttcgtgatcttttgccattaacggatcaccccctgaaaaaatgatctcgtccagttcagggtgttgacgaatataatccagtgcttgtagccaattagctttattgccttgattgtcctgataagggaaatggcggcggaagcaatagcggcaattgactgcacagccacctttgaccaacaatagcgcgcggttacggtatttatgtaacaggccaggaacgacgctgcgctgttcatcaagtggatcgtgggtaaaaccgggagcggtaataaactcttcacgtgcggtcagcacctgaagtaataaagggtctgatgcattcccaggttgcatacgggcaacaaaagcgcggggtacgcgtagggggaataaacgacgagcaccagagccttgttgcaggtgagggtgttcatttaagaacaaaatacgtagcaattcgtccggatcggtaattacatcggcgagttgttgcaaccaatcttctctaattggcatgtttcgggttacaatgcttgccattttttaggcttactaccagtttcttgaggaccatcatggccagttattatagcaacgattttcgtcccggtcttaaaatcatgttcgagggcgaaccttatgcagttgagtccagcgaattcgtaaaacccggcaaaggccaggcttttgcgcgtgttaagatgcgccgcttactgactggcgggcgcgttgaaaagaccttcaaatcaacagattctctggaaggtgccgacgttaatgatatgaacctgacttacctgtataacgacggtgagttctggcatttcatgaataacgagacttacgaacagctgcaagctgatgccaaggccgttggtgataacggtaaatggctgattgatcaagctgaatgtatcgtaactctgtggaacggccagccaattgctgtgaccccaccaaactttgttgagcttgaaatcgttgatactgatccaggcctgaaaggcgacactgcgggtacaggtggtaagcctgcaaccttgagcaccggtgccgtggttaaagtgccattattcgtacaggtcggcgaaatcatcaaagttgatacccgctctggcgaatatgtttctcgcgtgaagtaagccgtgatagctaggtttgtaatagccagtttgtcatggcgaggttcgtcagaactacgtcgtaatcaatcgcgctaagaacgaaaggaaaccgcttaaatggcggttttctgctatctggcgctagcaatattgccgctaattattgagcatgataatgtatcgcgcttatctctctgctggctgggacgacccagttacgcatctgtttttcggggacggccccgcctgagcgaggtggttaccatggcttggattattctggttattgcaggtttattagaggttatttgggctattggcctgaagtattctcatggtttttcgcggctgacgccgagcattattaccctcgtcgcaatggctgccagtgtttttctattggcctatgcgatgaaaagtttgccagcaggcacggcttacgcggtctggaccggcattggtgcggtaggtacggccattttaggcattgtgctactgggggaatcggccagtctggcgcggatactaagcttggggctgattctggcagggattatcggcttgaagttggcgtcataacgcttgagttataacgttatgtgccataagggggctgcgcccttcgccggttggcctacggaggtcaaatgagtcgtaaaatttgggcaaccgaactgagcgctttaaccaaagaacggcctgccagaacagcaggccgcgaatacggcatatggtgactacggctacagcgtcagtacaccgataaaagtgaccacactcaagattgccgcaaggccatagaatacccatttccctgccgggacgtggattttcaaatcatgcattgcatgatgaatacggtgtaaaccgcaccacaaaggcaaaatgatcatcagcagcaggaatacccggccaataaagctctgacaaaatgccagaatgcgttcgtagctcagcgcgtcgcctgggaatgcacccaatggcaacaaaatcgcgaccagcagaataatcacaggggcaataattgcaccccacatgccacccgcaccaaacagaccccagaagatcggttcatcggagcgtttagggacttgattcatctttttctcctccgggttagagtaaggcgacagccaggataatcgcgctagccacgacagtcacaacccatagcgccttaatcattggctctggacccattttttcgcttttaacgataatattgaccgctttcggcgccagctcaaaccaggttttggtatgtagcagcgcggcaaatagcgtaaggatattcagaaatagcaccagcgggttttgcaggaagctgacaaacccttcccaccctgcggggccactcttcagtgcgaatacaccgtaaatcaatagcacactaaaccacacggctggaatggatgtaccttcacgcaacatataaaaacggtagaaaccaagctgttgccaccagtttggagccatggtacgaacataagctttacgtttggttgtcattactgtctcccctcccttattgtggtttcagcatggcgatcatgaagtctttcgcactgtcgatcttgccctgctggatagccgccgcgggatcaacgtgttttggacacacttcagaacagtagccgacgaaggtacagctccagacaccatttttaccgtttagctgaggcatacgctctttcttaccgtggtcacggttgtccaaattgtaacgatgcgccagggtgattgctgcggggccaataaactcagggtttaagccaaactgtgggcaggcggcatagcacaaaccacagttgatacagccagagaactgatggtatttcgccatctgggctggcgtctgcttgttcgggccatccttgggtaggcgttcgttaccaatgatataaggtttgatggcttccagactctcgataaagtgagtcatatcaaccactaaatcacgttcaatcgggaagttacccaacgcttcgactttcatccccgcagtatattcccgcaggaaggtcttacaggcgagttttggtaccttgttgaccatcatgccgcaggaaccacaaatcgccattcgacaagaccagcgataggagagatccggtgccaggttatctttgatataacccagtgcatccagcagagacgtctgttcatcgtaaggcacttcgaaggtttcaaagtgaggttcgctatcacgttccgggttatagcgcatgacttccattttcaggactttcatatcagtcattcgcttgctccttatcctttaaatcttgtgcatcttttgcgtctttcgcgtcttgggcggtggcttcgccaccatagacccgcttggccggtaccagtttggtgattttcacatcgctgtattcaatgcgcggtgcaccacccggcgtatggaaggctaaggtgtgtttgaggaagttaacgtcatcacgttcggtacagccttcgtccaaacgctggtgggcaccacgagattctttacgattgagcgcagaatgcgccatacattcggccacatccaaaccataacccagctcaatggtgtagagcaggtcagtgttaaatacactggagtgatcggtgattttcacacgtttgaagcgttctttcagctcggccagtttatccaccgttttctgcatcagttccggtgtacggtaaataccgcaaccctcttccatcgacagacccatttcatcgcgaatcttagaccagttctctgttccttcctgtttcatcagattgctcagacgggtctccacatcacgagtctgggcatccagtgcgctaccatttgccgggccgctttccatcgcgcgtaaagcggcttgttcaccggccactcggccaaataccaccagttcagccaatgaattggagcctaaacggttagcgccgtgcaagcctacagaagagcattcgccgaccgcaaacaagcctttgattcgggtttcacactgcggattggtttcgatgccgcccatggtgtaatgcgcggttgggcgtacagggatgggctctttaaccgggtcaacgccgacataggcttttgccaattcgcaaataaacggcaggcgctcaagcagcttcttctcacccagatggcgtaaatcaagataaaccacatcgccacgtggggtcgcgaccgtgcggccagcgcgccattcatgccagaatgcttgcgagactttatcccgtgggcctaattccatgtacttgtttttaggctcaccgagtggcgtttcaggccccatgccgtaatcctgcaagtaacgatagccgtctttattcaccagaattccgccttcaccacggcagccttcagtcatcaggatgccagaccccggcaagcccgttgggtgatattgtacaaattccatatcccgcagtggaacgccatggtggaatgccatccccataccatcaccggtaacaataccgccgttggtgttatagcgataaacccggccagcccccccagtggccatgatcacggcgttcgcacggatttgtacgcgggtgccttccatcatattcatggcaaccacaccacgtgcctgaccctcgtctaccagaatatccaggacgaaatgctcatcaaaacgctgaatttgtggatacttaagggaggtttggaacaaggtgtgcagcatgtggaaaccggttttatcggcggcaaaccatgtacgttcaatcttcataccaccgaaacggcgaacgttaaccgaaccgtcctctttgcggctccatgggcagccccaaatttctaactgtgccatttcttcggggcaactgtggacaaaatggtcaacaacatcttgttcgcataaccagtcaccgcccgcaacggtatcgtggaaatgatagtcaaacgtatcgtggtcctgtgtgacggcagctgatcctccctcggcggccacggtatggctacgcattgggtaaactttcgagatcaaagcaatcttcagttgggggttggcttccgctgcggctattgctgcacgtaagccagcacctccggccccgataatggcaagatcggcgttaaaggtttgcactgcgcttctccattgttcaagtgaaaatcttataccctccgcccctgccgttacagggtgttagctaactgcctggctgtaacgccaagggttttgagtatataaagtgagtcattattctttaggtattcttaatattattattccgctaacttatttctctgcggttaacttgatgatattaagaatagctatttcttactttttgtatggaataattatactcaatgataagtcgcagaaatttgatgtgatcgattgttttgttttatttgaaccgcctcaaatgcattactgacaaaaacgtgatcccaaacaggatatgctgggaaaggcgtttttttacagcgtgaaatgctagaaccagaccgagaattcggcggatgagtgacagatttgtctggggcgcgggatacaggtagactgcatcccctgtttgatttcggagttaaccaccatgagcgacacggcaagctggcagccaagtgcacctatcgccaatttgttgaagcgcgcagcaataatggcagagattcggcgctttttcgccgatcggggcgtattagaagtagaaacgccaaccatgagccaagcgacagtgacggacattcatttagttccattcgaaacccggtttgttggcccgggcgctgccgatggtttgacgctgtacatgatgaccagcccggaatatcacatgaagcggttgttagcggcgggcagtggccctatctatcaactgggccgcagtttccgcaatgaagaggctggccgctatcataatcctgaattcaccatgctggaatggtaccgccctcattatgatatgtatcgtttaatgaatgaggtggatgacctgttgcagcaaattttggattgcaacagcgcagagaccttatcctatcagcaagcgtttttgcgccatttaaatattgatccgttgtctgctgaaaaagcacaattgcgtgaagtggcggcaaaactggatttaagcaatattgcggataccgaagaagatcgcgatacgttgctgcaattgttgtttactgtgggtgtcgaaccttatattggccgtgataaaccggcatttatttatcatttcccggcatcgcaggcatctctggctgaaatcagtaccgaagaccaccgtgtggcggaacgctttgaggtgtacttcaaggggatagaactagcgaatggtttccgagagctgactgacggtgatgagcaactgcaacgctttgagcaggataaccgtaaccgtgcgaaacggggcttaccacagaacccaatcgatatgaaccttatcgcagcactaaagcagggtttacccgattgttcaggtgtggctttaggggttgatcgcttggtgatgctggcgttaaatgcggaaaggttgagtgatgttattgccttccccgtcaatatcgcctaattccccttcgtccttggcgccgcagcggtgttagcggcgtgcactcacccgaatcacttactgatgtaagctcatcgggattcgtttacttgctgccttgctgcaacgccaatgactttggggaatattttgtgtccttggcgccgcaacggtgttagcggcgtgcactcacccgaattacttacaaaaacaaataccctgacctgtgaaggcgcagggcatttttatttcttactcactgagattacaaactacccggtgtgcggctgcggcccgaagaaatcgtacgtccagtgccgcgccccagagtttctaaccgcgcttggaacggtgggaatggtagggtaataccgtgctcacggtagccggccagaatcaactgatggatttcatggcgcagtggcatccggtggcccatttcagcggcataaatacgcagttcgaaaatctgaatcccttgttgtagatcgaccagatagacctctggaggcggggtatccaggactaacgtgcagcgctgggccgcggtcattaatacgttagtgacttcctcactgctggtctccgcgggtgcgggaacggtgaggaccacacgggtaatggaatccgagagtgaccagttaataaattgctcggtaataaaagctttattcggcacaataatttctttgcggtcccaatcggaaatcgtggtggcgcgcgtattgattttcgtcacgctaccagtgagatcacgaatggtcacggtatcgccaatccggatcggtttttcgaacagaatgatcaggccagaaacaaagttggcaaaaatctcctgtaaaccaaaacccagacctaaaccgagtgcggcaaccaaccattggaacttcgcccattcaatcccgagcagggagaacccaagcaaaccaccaaataagatcaccagatatttggtgattgtggagatggcatagcccgttcccggcgtcagatccaaatgctgtaacagtgccagctccaataaggcgggcagattacgcaccaactgagcggtgataatcagcaccaagacggcgatcaataaagatcccatggtgattggctggactgactcaataccgttgatggtggatgacacatcccacaagcgaatgttttccaggaagccaaaagcggaatgaatttcagaccacagcacgatcactgaaaccaaggctatcatggtcaggatcgacctaaccaaccgcaaggattgggcgctgatcacatccaaatcaatgatcggctcctcgacatcaatcgagccttcagtgctgttactgtgtggcgaatcttcctcaccacgggcgcgctgcgcgagaatatcggcgcggcgctgcttggcgcgatcaaaggcaatacgccgccgctggatcagcatccaacggcggataatatgatagaccactaacaggaagaaccagatagcgaccgaggtctccagacgtgccaacagcgcttgtgaggtggtgagatagcctaatgctgaggccagcgctgcaattaacggagctgacagcagcaacccccacagcgccacgttaatcatattctcgcccgaaccttttttatccagatacagcgggataccggcccgtttcaggctgtttgtgaccaaacttaatgcaatacacagcaaaataaagcacagccggcccagtgtcccagcaaactcgcggtcgttataattttcaaacgtaatcagcgccatcattaatgggacaattaaccatattgacaggcggtaaaaacgcattgcgcgcgcaacttgtgttggcgaccagcggaagtgagtaataaacagcccgtgtggatgagcaaacgaggcgctgatcataaacacccagagcacgggcacggtggcagtgacggcattgccaatcgcaatggccatcggatatgaccaggcattttgcagaccataacccagagccgcccataaaactggcaaggggagagccatcagaattgaccagaataccgtgcgtaacgtcagggagaagtggtcttgtgtcactttgcccacccgactactggcccgttcgaggaaggcatggtagtggcggcgtgagctaacactgaaaccgacaaacagtagggcagcgataatgggcagcagggtttcctggctggtcatcatcatgacaaaagcgccactcaactgcgacaaggtatccagtgacagtaggcgggtgaggtcctgagccacagcaagaggataagaaagcgaaatagggctgacatctgccacccagaacagatagcggtgagtggcttcacgcaccccatttaatgcgtcaactaactgactgttagccactttcagtttggtcagttccagaatttgcgtgtcatagcctgaaagcagagaattcagtaattcgctctgtgtccgccattgggcatccagaatgcgttgctgatcgggcgtgagcggggtgccatcatcctgttttaacgtggttttctgttgctgtaatttttccagcatatcttcatattgcaagcgctgaacccgcaactgtgccatatcgcgatccagttgttgggatttgggcatttctggcagcttggcgacctgcgctcgtagggtttcgcccaacgcggttgagaccccaagccattgagcctgctcacggatagtgtttagcgcttgccggacttgctgagtttgcgcgacagcctggcgttgctgggaagagataagatcaatccgctgtacctgctgattaagcgcctgagataactcacggtttctttgtaactgctgggtgatagattcgggtaaatcccccccttgctctgccagcaactctgtccgctcaagtgcctgttccgcggcttgttggcgttgattattcaggttattacgcagggactgaagctgagcctgaacccgtgcttcgcgctttttgtataattcgacttgtagccgggacagctcctgccggttattggcagacagttgtgaaagctctaactcattgactttggctttacgagccaccgcttcagcttgcaatagcgtaagctgagcttgggcgacgggcgacgagggattactttgtgactgaattcgcgggccgatctctgcgagcattcgccgggcttcggactgttgttgcggtaattgcccaagggattcactgatttcccgggcgcggtcttgctcttgctgtgataaacggttcagctccagcaattggctgctgacttgtagcacctgttgttccaaatcagatgtggacaagttgctggggaccggtaaaggtttatccccttcctgggctaattgctgacgtaactcgcgagtaagcttaggaaaatcatcaatggctttttgatactgctgggcgcgtatatctgattcttttgcatccgcaagccagctaagagccccttgaagcgcctgaacaatctctgcctgattcggtgtcgttttattggactcagccagcttgagctcttgccgcacctgctcttcgttaggctgagttgccgcatgtagcggcattaacaggaaaaacgacagtaatagaccaaaagaccatgaaattatcgggcgcacgtaagagctccttaacatcgtgttacgtcgtcagcatcatgctagtaagaaggggtagtaggaaccgcttcggctaagacttcacccatacgggtaaccgcgccgctgtttagctgtggtgcgaaatacactttaccttccgcaaacaggttaataacggttgagcctaatttaaaacgccccatttcttggcctttctctagggtgatagccccttcacagcctgcttgcgggtatgtccaacggcggataacgccttcccgtgggggggtaattgtccccgcccagacggtctctatactgccaacaatggtcgcacccaccagaatttgggccattgggccaaaggcggtatcaaagatacaaataacgcgttcgttacgggcgaacaaattaggaacattggcagcggttaacggattgaccgagaacaaatcccccggtacataaatcatttcgcgtagcacaccatcacatggcatatgcacccggtggtagtctcggggggccaggtaagtggtaacaaactgcccattttgaaattcagcagccagcagatagttaccggctaatagggcttccagactgtaattatggcctttcgcctgtaaaatttgcccctctcggatggcccctaactggcttattgcgccatcggcaggttgggctaacaggttttcttcagccacaaccgggcgtacacctgcgcgtaacgggcgaacaaagaattcgttgaaggtacggtaagcggagaattcaggatcctgcgcttctttcatatcgaccttgtaataacgggcaaaagctttgatgactaactgggtcaaccagccgccttgcttattcgctccccagccagcgagttgtgttaacccttgtttcggaagtaaatattgtagtttaattttgatactgtctagcacgtcaacctcttgggtaaaccgttagataaaataagggggcgcattgtatcgctctgcgcccaccctgtcagacccttcttacttgacgccacagcagcgttagcggcgttcgctcacccgaatcactgactgatgtaagctcatcgggactcgttcacttgctgccttgctgtgacgccaattaatttgggtaaacccttcttacttgacgccgcaggggtgttagcggcgtttgctcgcccgaatcactgactgatgtaagctcatcgggactcgttcacttgctgcacgtcagtaagcgtatagaaagctgttagttaagcatcacttctcgtcactgtctgacgttttacgcggcttcgcttgctccatactttctaggattcgatggtaattatcgaaacgttcctcagcaattttaccttgctctacggcttcgcgtaatgcacagccgggatcgttggtatggctgcaatcacggaatttgcaatggccgagataatcacggaattcgacaaacccttgagtaatttgttccggagctaaatgccacagaccaaattcacgcacgcccggtgaatcaatcacatcaccgccatgttggaaatggtacagacgtgcggcggttgtggtgtgctggccgagacccgagttaccagaaaccgtattgaccaaaatttcgttatctgttggcggcaacagggcattcaataggctggatttgcccaccccggattggccggcaaagatactgatacggccagtcagtgcattctcaaaggcttccatcccctcacgtgtctggctggagacttccaagacgtcgtaaccaatacgacgataaatatccatcatgccatcaacgaatttacggccatcggcatccaacaggtcaatcttattcaggacgattaacggctcgacttccagtgtttcgcacgccaccaaatagcgatcaataatattaagtgaaagctcgggtaagatcgccgatacgatcacgatctggtcgatattggcagcgataggtttcacaccatcatagagatctgggcgagtcaggacggatgtccgttcgtgaacggcttcaacgatacctttaactcgcacaccttcctgcgcttgtaaaccgggacgccagaccacccgatcaccagtcaccagtgatttgatggttcgacggatattacaacggtgctgagtgccatcaacggcctcgacatcggcatgctgaccgaagcgactgattacgataccttcttgcgcatcgccaagctgagagtcatctaactcaggttttctatcagtgcgtagcctacgctgatgattagcctgtacacggcgttgttgacctttcgacagtttattcttgctcactgtgcctcacttgaatctgcatttatccccttcggactttgcgttgtagggggtgttagcaatgttcgcttgccacctgcttgcaacgccaagttctttggatatatcgctcgttgcgaccaaaaggactatgatacacattattttattaattaaccgtttgttcggttgctcccccggcttacagataggaaatatcatggcagaaaatcaaaataatctgatctggatcgatctggaaatgaccggtctcgatccagagcgggatcgcatcatcgaaatcgctaccttggtcactgatgcgaatcttaatattctggcagaaggacctgttctggcagtccatcaatctgctgaacagcttgggctaatggatgagtggaatgttcgtacccatactggtagtggcttggttgagcgggtgaaaaccagcccctttaatgaccgtgatgctgaattacaaactatcgaattcctaaaacagtgggtccccgcgggggtttcacccatttgcggtaacagtgtaggtcaggaccgccgtttcctgttccgctacatgccagagcttgaagcgtatttccattaccgctatgtagatgtcagtacattgaaagagttagcgcgtcgctggaaacctgaaattctggctggttttaaaaagcaaaatacccatcaggcattggatgacattcgtgagtcagtcgccgagcttgcttactatcgtgagcattttattcaatcttaattcccttcggccttgaaacagcaggggcgttagctgcgcgcacttacccgaatcacttactgatgtaagctcatcgggacgcgtttgcttgctgcctgcctgctgctccaatgacgttgggaattcccttgatacttgaaacagcaggggcgttagctgcgcgcattacccgaatcactgactgatgtaagctcatcgggacgcgtttgcttgctgcctgcctgctgctccaatgacgttgggaattcccttgatacttgaaacagcaggggcgttagctgcgcgcacttacccgaatcactgactgatgtaagctcatcgggatgcgtttgtttgctgcctgcctgctgctccaccaatgattttgggtatatactctgtctggtgctggtaaaaacaccatattgctgttttaatcgacacttaaatagaaaaatgatttttttgctttcaggggcttgcggcaaaacggatttctcgtataatgcgcaccccgtaccgatgaagaattcgcaagcatgcgaagacagatttagtacaagataagtcatatccagagcgggaatagctcagttggtagagcacgaccttgccaaggtcggggtcgcgagttcgagtctcgtttcccgctccaagttctttagcaataaagaacttcagtcagaagtaaagagcatcagaaataaaaagtgtataaataaccaatgggtatttatacaggcgacgcgggaatagctcagttggtagagcacgaccttgccaaggtcggggtcgcgagttcgagtctcgtttcccgctccaaatttttatttgtcagaataagatttcacctgctttcagatacagcagggtgtaatagcacctcaatgcgggaatagctcagttggtagagcacgaccttgccaaggtcggggtcgcgagttcgagtctcgtttcccgctccaaattttttcattcaattcctgattatttatccacagctagagtgggtacgatgttgcgcctcacatacttagcgaattaacttcgtcaacagacttatccacagattctgttctttttatatccagcttgtaatttgtacgttaaattttcctgtcaattatattactgatttatttgcatatatttttatatagaaacgttatgccgatcacttgtgcttttttttgcacttgattgccaaggcatttttatttttatgcacagtaaattccttatcttattcatcaaaaaaatgctgaataaaaagatatcaggcatcccgtggtagacccttttcaatggcacgaatcaaccgttttttctgtggcagttgaacctctaccgcctgggtagcccgccgtgctaattgctgtgatatcgcccattcaatatgctcatccagcatagggtgcagcccccgacgtgtttccaacgccaatacgatactatcaagataaggcgcattgccgagtgctaccgatatgttacgtaaccaacgtagatggccaatacgccgtatggcagacccctccgtgactcgcaaaaatttctcttcgttccaggcaaacagatccagcaactgtggagtgtgcaataccgctcgtggactaaaatcgtcttcatcggttaattgcgagaagcgattccagggacaaatgagctgacagtcatcgcaaccataaatccggttacccatgagtgggcggaactcttcaggtattgcgccttccagttcaatcgtcaggtaagagatacagcggcgggcatcaacggtgtagggggcgacaatcgcccctgtcgggcaggtggtcatacaggctacacagcgcccacactgctcttcctgcggtttatcaaccggcaaaggcaggtcaatcagtagctcgccaaggaagaaccaagaaccggcatcgcggtttaatatcagtgagtgcttaccaacccagccaatccctgctttagccgccagtgaccgctccattatcggcgcggagtccacaaagggacgaaagttaatttcactggcagtatgctgttccggctggccttgtcgttctgagtcatgttgttctaagtcatggagctctaagtcatggcgatctaaattattttgttccaaacaatagtgttgaatctgatcgcccaattttttcaggcgctggcgcagcaatttatgataatcacgacccagagcatagcggctgacataacccaattctgggttatttaatgtactggcaaatgctgccttggcgggcagataattcatccttacgctgatcacccgcaaggtccccggcaataactcatggggccgcgcacgcagcataccgtggcgtgccatccacgccatttcgccatgatattgtttatcaagccaggcttgtaaacgcggttcttccgccgtcaaatcggtatcgcaaataccgacttgctggaaacctagcgattgcccccattgcttgatatgttgggctaattgattcagatcgagggggtgtgccatgacagaccatagtaagaaacaaaccagagtcagtttaccacactctgttttttctgcggactgggtacgtcagaatgaagcagcggcggcggcccacttctcactgaccctgtttgatctgatggttcgagccggaaacgctgcctttgaactggcgcataaacaatatcctatagcacgtcattggttgattctgtgcgggcatggcaacaatggcggggatggctatatcgttgccaaccgcgcgttggctgcgggtatcgatgtgactcttatcgcctgtccaggtaaccgccctttacctgcggaggcgaaagaagcgcaatctcaatggctggctatcggtggtgttattcaccaacctgatacccagtggccacaagatattgatttaattattgatggtttgttgggaattggcctacgggctgcaccacaaggcatctatgagactttgattgacatggctaaccgccatcgggcggcaaaagttgccttggatattccctccgggctgtgtgcggataatggtgcggccctcggttcggtgctccgtgctgaccacacgttgacttttgttgcattgaagcccggtttactcaccggtcaggcccgtgattgggttgggcagttacattacgatgatctagggttggcaacgtggttggatactcagtcagcacaaattgaacgaataaccgccgatcatcttcctcagtggctgaaacctcgccgcccgtgtgcccataaaggggattatgggcgtctgctgttggtgggcggtgatagagggttcggtggtgctatccgtatggcgggggaagccgccctacgaagcggcgctggcttagtgcgagtacttactcactttgagcatgtggcaccgattctggctgctcgcccagagttgatggtgcaggcgctaaccgccgaaaccctggagcaaagcatgcaatgggctgatgtactggtcgtcgggccggggttaggtcagtctgattggagcaggaatgctctgaaacgactgcaacagagtgataaacccacattgtgggatgcggatgcacttaacttactagcattaaatcctcataggcgtcagaattgggtattgactcctcatccaggagaagctgctcgtctcctgggttgccgcgtcgttgacattgaaagtgaccgcttactttcggcccgaaacatcgtcaagcaatatggtggtgtggtggttttgaagggcgcgggtaccctgatcgccaatgagcaaggtgagatggccattgccgatgtgggtaatgctggcatggcctccggcgggatgggcgatattctttttggtattattgggggtttgatagcacaaaagctggcgctgtatgatgccgcctgcgcggggtgtgtcgtgcatggcgttgctgcagataagctggctgaagttcaaggcacccggggtttactggccacagatttactgcctgttattccgaagtacattaatcctgagttagcaaaatagatatcatagaatgaaagaactcgttttactgttgcctgatgaggcagcgactgttgcattaggagccactttggctcgagccttcggtggtgccagcgttatttatctgttcggtgacttaggtgccggaaagaccacttttagccgcggttttttacaggcgttgggccacaatgggcatgtgaaaagcccaacgtatactttggttgaaccttatacgttgacgccaaggcccgtctaccattttgacttatatcgtctggctgaccccgaagagttggagtttatgggcattcgcgattacttcgacccgcaggctatctgtttggtggagtggccacagcaaggcgcagggttcctgccgcaggctgatgtagaactgcatctgacttatcaggcggcagggcgtgaagcccggttggtcgctatttccgaggcaggcgctgacgtgttgcgccgtttagccgctgtgcaagggtaacgaaacgatgatgcatagcctctcgctgatatgtcgctggaaacacggtttcgctacgattcgccatttcactacgatttgccatttcactactgtccgccgcgtcattactgctcgtcgtttcgccacggtcacgcggatggttattggtttattaacgctcagtttattcgctctgcctcccgcatttgccatgaaactcactgacattaaggtgaccaacggggcgagtgaaagtaaggttactctcagctttgatggtaagccaatttatgcatttttctcgctaaactcgccggagcgggtggtcttggatgtccgccaaagtggcaatatctcagggttgccgctggagttcagtgggcagaacctgttgaaacgaattcgctccagcactccgaaagatgaacaaagtacccgcctggtactggaactgacgcagaaagtaaaaacccgtgctgtcacccaacagtcgggcaataactacacggtagtgcttaccatgacggccgtcgccagtgcccctgttcgtcaggcgcaggcctcattaaatcagacgaataccccgagtcctaatgccgggcgtgtggtgcctcaagtcacgagcaaggattcagtagctaaaaatccgtttaataataagcccgtcgtcgtggtcagtagcgaaaacgtgaccacgaatactgcccgtcagattaaaactgtgagtgcggctaacagtagccgtgttgtggtggccatagatgccggtcatggtggtcaggacccaggcgctatcgggcaaaatggtctgaaagagaaaaatgtcacgatctccattgcccgccggcttgaggcactgctcaaccgggatccgatgtttaaaccggtgctgacccgcaatggtgattactttatctcggtcatggggcgctctgatgttgcacgtaaacagggggctaatgtcttgatttctattcatgctgatgccgcgccaaatcgcagtgcgacaggggcatcggtttgggtgttatcaaaccgccgggctaatagtgaaatggggaactggctggagcaacatgaaaagcaatcagaactgctcgggggcgctggtgatgtactggcaaacacggcttcagacccttatttgagtcaggcggttctggatttacaatttggtcactcccagagagtgggttatgacgtcgccactaaagtgctgcgtgagctacaaacggtgggtgatattcataaacgcaagccggagcacgccagccttggggtgttacgttcaccggatattccgtcgctattagtggaaaccggctttatcagtaatagtacggaggaacggctgcttggcagtagcgcgtatcaggagaagattgctcaggccatttataaaggcttgcgcagttatttcctcgcgaatccgttacaagccgacccaaaggtcgaaagccgtccgctcattgaaacagcggcggttgactcctcaacacagcgttcaggtattagtcagccggaacctattgtgaataatataagcagtaatgcgcaaagtggccggtcatcggctactctgcctgcaggtaagagcaaaatccacaacgtgcagcgtggggagacgttatcgggtattgccagccaatacggcgtcagcatggctgttttacgacaaaataatacgctgaaaaatgatgtagtctgggtaggccagcggttgaaagtgcccgcgtcgggcagtacggtaacggcagtcaagcctaaaacagccgctgtagcaaaaagtaaacctattaagcatcaggtgaaacgcggtgatacgctgtcagccattgcggcgagatacggtgtatcaatgagtgagattgagcgggtgaataaaatcaagtcaggtaatgttcagcttgggcaaacgctcactattccacaatcgtaagcgcaaggaattgttatgccgattcagattctgcctccacagcttgccaaccagattgccgccggtgaggtggtagagcggcctgcatcggtagtcaaagagttggtagaaaacagtctggatgcgggtgctacacggattgatattgatattgaacgtggtggggcgaaacttattcgcatccgtgataatggctgcggcatcagtaaagatgatttggcactggcgttggcccgccacgccaccagcaaaatcagttcactcgaggatttagaagccatcctcagtatggggtttcgcggtgaagccttggccagtatcagttcagtttcacgtcttatcttaacctcacgtaccgctgagcaaagcgaagcctggcaagcctatgccgaaggtcgcgacatggcggtcaccatcaagcctgcggcacacccggttggcagtacacttgaagtgttggatttattttataacacccccgcgcgccgcaaatttatgcgaactgaaaagacggagtttggtcatattgatgaggtcgtcaggcgcattgcgctggcgcgcttcgatgtggcaataaatttgaaccacaatggtaagttaattcgccaatatcgtgcggcaccagaccctgcccaacatgagcgtcggttggcaagtatttgtggtccggcgtttttgcaacatgctttggctatcgcttggcagcacggggatttgaacattcatggttgggtggcggatcctgccgcgagccatacgctgagtgaaatgcaatattgctatgtcaataaccgcatgatgcgtgatcggttgattaatcacgcgattcgccaggcttatcaagatcgactcaacgatgctcaacagcccgcttatgttttgtatctggatatcgatccgcatcaggttgatgtcaacgttcatccggctaagcatgaagtgcgttttcatcaggctcggttggtacatgactttatttatcaggcagtcactgcggttttacaacaaactaatgcgccgatactgaacatcagtgaagaaggtgaagttgacgctccacgttggcagcaggaaaaccgggtagcggctggcaccaataaatatgctcaaccggaagcggcgaaatccagtgcggcggagcaggctgtggctcgcgagcgttcgtctgcccgtgaacgcgctgcgccggcctataaagaagatcacccctatcagaagcaacaaggggagttataccgccagctattgcaaccgtcagcggcagccaaacccgcaacatcgccagcggcaatacctgcgtcatctgtttcctcaccatccatcccggttcaacgaattactcaggcagaagagccgcttcacggtgataattacagttttggccgagttttaacggtttttccaccttgttatgctttgattgaatatcagggcggggtagcattgctatccttagccgttgcggagcgctggttgaaacaagctcagctcagcccgccagaagaggggttacgccctcaaccgttattgattccactcaaaatcacattagacaaaaatgaaatagcggcttgtcagaaccatgaaaaattgctaattaccatgggaatagagctgagtgtcgagcaggggcgggcgaccttacgtgcggtttctttaccattacgccaacaaaatttacaaaaactgataccggaactgttaggctatctgtcgcagcatgaagagatatcgccagatacactggccacatggcttgcccgccatcttggtagcgaacatgaggtatggaatgtgtctcaagcgatacagttattgacggaagttgagcgtctttgtccgcagttggtgcaatctcctcctgctgggctattacaacctattgatataaaggccgcattggcaactttgacacatgaatgatattgagaatctagatcgtccaccggcaatttttattatggggccaactgcttccggtaaaaccgcgctctctattgcgttgaggcagcgattgcctgtggagttagtcagcgtcgattctgctcttatctaccgtggcatggatatcggtaccgcgaaacccagtgcacaagagctggcgttagcgccacaccggttgattgatatccgtgatcccgctgaatcatactccgctgccgattttcgtaaagatgctctgaaagaaatggccgacatcactgctgcggggcgtattccgctgctagtgggggggacaatgttgtattttaaagcgctgttggatgggttatctccgttaccctccgcagatcctcaagtacgccagcgtattgaacagcaggcgtcggagctcggttggggcgcattgcaccagcaattggctgtgatcgatccagtcgcggcggcacggattcaccccaatgatccccaaaggctctccagagcactggaagttttttttatttcaggtaaaactttaacggaactgactaaaatttcgggtgaaaccttaccttaccgggttcaccaatttgcgattgcgcctgctagccgggaactgttgcaccagcggattgaattacgttttcatcagatgctggatgcagggtttgaagcagaggctagggtgctttttgaccgcggtgatttgcatacggacttgcctgccattcgttgtgtgggataccggcagatgtggtcttatctgtctggtgagattgattacaacgacatggtataccgcggagtttgtgcgacacgtcaactggcaaagcgccaaatgacctggttgcggggctggagttcagttcaatggctcgacagtgataagccgggagaggctttagactccgtaatacaggttgttagtgcataggttgaatgattgtgtacaattgattagtactcaacgcacagattttttttacgcagtttattttcgagccgataggttcttagttaaaaacaacaagcaaataaggaaaatatagaatggctaaggggcaatctttgcaagatccgttcctgaacgcattgcgtcgtgaacgggttccggtttctatttatttagtgaatggtattaaactgcagggccaagttgagtcttttgatcagtttgtcattctgttaaaaaatacagtcagccagatggtttataagcacgccatctctactgttgtgccttctcgtccggtttcgcatcacagcaatactccgagcggtagcaccaataattatcatggtagtaatccgtctgcgccgcaacagccgcagcaggacagtgatgacgctgaataaagcccattgctggtcgaccatgatggagaacataagcaacggattcaagcttatgttctccgcactagcggctttgatccgtttgagaggttgcacgtttgtttgaccgctatgaagctggtgagcaggccgtactggttcatatttatttctcgcaaaacaaagacacagaggatctgcgcgagtttgaagcgctggtatcttctgcgggtgtagaggctttgcaaattgtgacgggtagtcgcaaagcaccacatcctaaatactttgttggtgaaggaaaggccgaagaaattgcagacgcggtgaaagccagcggtgcgtctgtcgtcttgtttgatcatgccctttctgcggcacaagagcgaaatcttgagcgtttgtgtcagtgtcgggtgattgatcgcactgggttgattttagacatttttgcccaacgagctcgtacccatgaaggtaaactacaggtcgagttagcgcaattgcgtcatatcgcgacccgtttggttcgtggttggacgcatcttgagcgtcagaagggcgggattggtctgagagggcctggggaaacccagttggaaactgaccgccgtttgctacgtgatcgtatcagcttgattttaagccgtttggagcgtgtagcgaagcagcgtgagcaggggcggcgtgcgcgtacccgtgctgatattccgacggtgtccttggtaggatataccaacgcaggtaaatccagcctgtttaacaaaattacggcagctgatgtttacgcagctgaccaattatttgccacactggaccctactttacgccgtataaatgtggctgatgtaggtgatacagtactggcggatacggtaggttttatccggcatttgccgcatgatctggttgctgcgttcaaagcgacactacaagaaacgcggcaagcctcattactgctacacattattgatgcagctgatcctcgggtcgccgagaatatggctgcggtagatacggtattggcagaaattgaagcagatgaaattcctacgttattagtaatgaataaaattgatttgttggacgattttgttccgcgaatcgatcgcaacgaagacaatctgccagtcagagtttggctttcagcccaaaccggcgcagggatcccgttgctctttcaagcgttgacggaacgcctttcgggtgagatcgcacactttgaattgcgcttgcctcctcaggcaggccgtctgcgtagccgtttttaccagcttcaggcaattgaaaaagagtggatagacgaggacgggaatgtcggtatggtggttagaatgcctatcgttgattggcgtcgtctctgtaaacaagagcaggagttggtcagttatattcaaaataattaatctggtgcggttaattacttgattatgcccaaaataattcgagtagcaggaaggcggcaactgagcgaatccccagaaactgacatcagttagtgactggggcgaacggaggcagctaacacataagcaacttgaaatacgaagggaatatctgatctttcttgtgagattaagagccagcttctttggcatgtgctcttggcctgaagaaaaccaatcatagaagaatggagctaaaacatggcgtggaatcagcccggtaataacggacaggaccgcgatccgtgggggagcagcaataataatggcggcaactctggcggaaataataataataaaggtggtcgtgaccaagggccgccggatctggatgatatcttccgtaaactgagcaaaaaactgagtagcctcggtggcaaaggtagcggaagtggtggtaatggcgcatcacatggccctggtttcagtggtcgtgttgtgggtatcgctgttgttgctgttgtggtcatctgggctgcaagcggtttctataccattaaagaagctgagcgtggtgttgtcacccgtttaggtaaattgagccacattgtgcagcctggcctgaactggaaaccgacctttatcgatgaagtggttccggttaacgtcgaggccgtgcgtgaattggccgcttctggggtcatgctgacctccgatgagaacgtagtgcgcgtcgaaatgaacgttcagtatcgtgtgactgatccggccgcttatctgtttagcgtgacgaatccggatgacagtctgcgtcaggcaacagacagcgcagtacgtggtgttattggtaaatacaccatggataaaatcctcactgaaggccgtaccatcgtccgtagtgatacccaacgtgtgctggaagaaacgattcgtccgtaccaaatggggattacgttattggacgttaacttccaggctgctcgtccgccagaagaagttaaagcggcatttgatgacgcgattgctgctcgtgaaaacgaacaacaatacattcgcgaagcagaagcctataccaacgaagttcaaccacgtgctaatggtcaggcgcagcgtctgttagaagatgctcgtgcttatgccgcacgtaaagtgttggaagcacagggtgaagtcgctggttttgctaagttgctgccagagtataaagcggcaccggaaattacccgtgagcgtctgtacatcgaaaccatggaaaaggtcctgggcaaaaccaataaagtgctggcgaatgataaaggcaataatttgatggtgttgccactggatcaaatgctgcgtggtcaaggtgctgctaataaagttgatggcaacaaagataccagtctgattcgtttgaatccggcacccagcagccaacaaactggtgcgagtaattcaaataccagctcaggcagtggttctatcatggatcagcgccgggtgaatgctcagcgtgatacttccactcgcgtagggagagaataaccaatgcgtaagtcttttttacttatcgtcgttgtggtgttaatcgcactcttcgcttcgctgtttgtcgtagaagaaggtcaacgcggaattgtgctgcgctttggtaaggtattacgtgatagtgataacaaaccgttggtgtatgcgcctggtctgcacttcaaaataccttttatcgagacagtgaaaaggttggatgcccgtattcaaaccatggacaaccaagctgaccgtttcgtgaccaacgagaagaaagacctgattgttgactcatacctgaaatggcgtatcagcgattttagtcgttactatctggccaccggtggtggtgatgtttctcaggccgaagttctgctgaaacgtaagttcagtgaccgtttgcgttctgaaattggccgtttgaacgtcagagacatcgtgacagactctcgtggtcgattgacttcagatgttcgtgacgccttgaacacgggtagtgtgggcgatgaggccgcaacgactgaagccgatgatgcgattgcctctgctgcagccagagttgagcaggaaacccgtggcaaacagcctgcggttaacccgaacagcatggcggccttagggattgaagtggttgacgtgcgaattaagcaaatcaacttacctgctgaagtttctgatgcgatcttccagcgcatgcgtgcagagcgtgaagcggtagcccgtcgtcaccgttcacaaggtcaggaagaggccgagaaattgcgtgcgactgcggactatgaagtcacacgtactctggcagaagcagagcgtcaggcgcgaattacgcgtggtggcggtgatgcagaagcggctcgtctattcgctgaagcatttagccaagatcctgacttctatgccttcatccgtagcttgcgtgcgtatgagaacagcttcagcagtggtaacgatgtgatggttctgagcccagatagcgatttcttccgctatatgaaatcgccagacaactctagcaaacgtccataacgacagttgcagagagtatggtgatagcgcgggctgtagcagtgcctatcatagccgtgaatcgtgctgtcaccgtgcatattgctagagtacgttcttgaacgtaacaccgaggcccgtctagtgcgggccttttcatgtgttgaagcagacaattttttggggcagacaatgaattcaaccatcttattggcattgggtttggttttggtgttggaagggcttggcccgatgctttatcccaaagcctggcgcaaaatgattcaggcgatgacccaattacccgatgctactttgcgccgttttgggggcggattagtggttgctggctgtgtgatctactacatgttgcgtagtcacatggggagctaaaggtaagcgcaaaaattgttcagttatgcgttaaaaagtactgaaagccgccgtatgagatgttagaatccttttttaagcaacctggtgatttttgagatgggtaagaacgtcgtcgtactgggcacccaatggggtgacgaaggtaagggcaaggtcgttgacctgctgactgaacgggctaaatatgttgtgcgctatcaaggtggccataacgcgggccatactttggttatcaacggtgagaaaaccgttcttcatttaattccctcaggtattctacgtgaaaacgtaatcagcatcatcggcaacggtgttgtactggctcctgacgcgttgatgaaagagatgacagagcttgaagcgcgcggtgtgcctgttcgtgagcgactgttactctccgaagcatgcccattgatcctgccttatcatgtggctctggataatgcgcgtgaaaaagcacgtggtgcaaaagctatcggtactaccggtcgtggtattggccctgcctatgaagataaagttgctcgccgcggcctacgcgtcagtgacttgttcaataaagaaaccttcgctatcaagctgaaagaaattgtggaataccacaacttccagttggtgcattactacaaagaagcggcggttgactaccaaaaagtgctggatgatgtattggctatcgccgatattctgacggccatggtagttgatgtttctgaattgttggacaatgcccgtaagcaaggcgagttgatcatgttcgaaggcgcacaaggcaccttgctggacatcgaccacggtacttatccgtatgtcacctcatctaacaccaccgcgggtggcgtagcgacaggctctggcctgggtccacgttatgttgattacgtgctgggtatcgtaaaagcctattctacccgtgtaggtgcaggtccattccctaccgaactgaacgatgaaactggtgagttcctgcgcaagcaaggtaacgaatatggcgcgactaccggccgtagccgtcgtactggctggttggatatcgtagccgttcgccgtgcagtgcagatcaactccctgtctggtttctgcatgaccaaactggatgtgctggatggtctgaaagaagtgaagctctgtgttggctaccgtatgcctgatggccgcgaagttgatacaacgccactggctgcagaaggctgggaaggcatcgagccaatctacgaaaccatgccaggttggtcagaaaccacctttggtgtgaaggaacacagtaagttgccacaggcagccctgaactacattcaacgtgtagaagagctgacaggtgtgccgattgatatcatctctaccggccctgatcgtgacgaaaccatgatcctgcgtgatccatttgatgcataattaactggcttacggccaagttatcatcattaatgagatatcagcattaaaatgtacggggttaacgcgtatatttgtgttcgaaacaataaaccgggctgatgtccggtttattgtctaatacatccagcttattgtttaatcggtcagcttattgtttgatcggtcagcttattgtttaatcggtatggtatggttgccctcggtcagtcgtttttacatcaaaaaaactacccttcaactaaatgattagtcacaggctttgtggctggtttatcattcaaagtataagttttctaaatagcacttagaatcgcacttatcacctattcaacagttgtcatttcagatgggtgtaagccgggtaaatggatactcaggggtatatgtgcagttaacaagttttactgattatggtttgcgggcactgatttatatggcctcgttacctgatggccaaatgaccagtatctctcaggtaactgaggtttatggtgtctctcgcaatcatatggttaaaataatcaatcagttgagccgcgtagggctggtaaccgctgtgcgtggtaaaaatggtggtatacggctgggtaagccggctgatcagatcctgattggtgatgtcgtgcgccaaatggaaccactcaccttggtgaattgcagtagtgatttttgccatataacacctgcttgccgtctgaaacaagtgcttaatcaggcggtacagagtttccttaaagagttggataactatactttggcagacatggttaaagataattccccgctctacaagctattacttgttgagtaggttttttacttaataaaaagagatatacccaaagagcttggagttgcaggtaggcagcaagccaacgaaaaatgggttttaaaccatttttaacggcgcttgcgttggcccgcaaaggggtgcctattcaagtaaaggcagcttcaagtcaatgattcgggtgattgagagcagccaacacacctgcactttgaaagacgatgggtatagcaacctgctgctgacaacggaggaacctcaatgtcacaagatccattcctggaacgagaagcagagaaatatgagtcaccaatccctagccgggaatttattttggctcatctcgcgaagcgcgagacacctgccagccgtgaagagctggccaatgaacttaatttaaccggtgaagagcctttagaggcgctacgccgtcgtttgcgtgcgatggaacgtgatgggcaattggtcttcacccgtcgtcagtgctacgccttgccagagcgtctggatttactgcgcggtacggttattggtcaccgtgatggctatggctttttgcgggttgaaggcagtaaagatgatctgtatctctccgcagagcagatgaaaatggcgatccatggtgatgtcgtcttggcacaagtggtcggggctgatcgtaaaggccgccgtgaagcgcgtatcgtgcgtgtattggtcccaaaaaccagccagatcgtgggtcgctactttaccgatgcaggtacgggctttgtcgtgccggatgacagtcgtcttagctttgatatcttgatcccagcagaggcgacctgtggtgcgcggatgggctttgtggtcgtagtcgaattgactcagcggccaactcgccgtactaaagcggttggtaagattgttgaagtacttggtgagaatatgggcaccagcatggcggtggatatcgcattgcggacccatgagatcccgcacacctggccgcctcaagttgaaaaacaagtcgcagatctgaaagaacaggtaccggaagaagcgaaaaaggggcgggtagatttgcgcgatctgcctctggttacgattgatggtgaagatgcccgcgacttcgatgatgccgtgtattgcgagaagaaacgtggcggcggttggcggttgtgggtagcgattgcggatgtcagttattatgtgcgtcctcaaaccgcattggatgacgaagcccggagccgtggtaactcggtctacttcccatcgcaagtgataccgatgctgccggaagtgctatcaaacggcctttgctcccttaatccacaggtagaccgcctgtgtatggtgtgcgagatgaccatctcttcgcagggcaaactctcgtcttataagttctacgaagcggtaatgagctcccatgctcgtctgacctacactaaggtgtggcggattatagatggtgaggaatcgctgcgtgagcaatataagccgctggtgccacatctggaagagctgcacgcgatgtataaagtgctggatcaggcgcgcgcagagcggggagggattgctttcgaaacagaagaagccaagtttatctttaatgctgaacggcgcattgaacgtatcgaacccacggtacgtaatgatgcccataagctaattgaagagtgcatgattctggcgaatatcgcggcggcgcgttttgtggaaaaacacgaagaaccggcgttgttccgagtgcatgatcgcccaagcgatgaccatattgtggcattgcgcagtgtgttgaatgagttggggctaacactcgggggcgggctgaagccgcaaccaaaagattattcagtgttgatggatgaaatttctgatcgccccgatcatgaaatgctgcaaaccatgttgctacgctccatgaaacaagcggtttatgatccagaaaaccggggtcactttggtttggcgctggcttcttatggccacttcacctcacctattcgtcgttaccctgatttggcgatgcatcgggctattaagtatcagttagccaaagagcacggtaatttaaaagatcgctggacacctacgggcggctggcacagcgatttcgaagatatgctgcaattgggccaacactgttcgatgaccgagcgccgagcggatgaagcaacccgcgatgtcgctgactggctgaagtgtgacttcatgctagatcaggtcggtaatgtcttcaccggtattattgccagtgtgaccggttttggcttcttcgtgcgtctggatgacctctttatcgatggtctggtgcatgtctccagcctggataacgattactaccgttacgacaacattggtcagcgtctgatcggtgaatcttccggtgtagtttatcggctgggtgataccgtggagattcgagtcgatgcggttcatatggatgagcgtaaaattgactttgctctggtctccagtacccgcaagccacgtggtgaaggcaagaccgcccgtgataaggcgaaaaataacggccagcgtacattacgcagtaattctgcaggtcgtggctcttcatccggctcatcgcgccgtgatggtgcgccaactgcgggtggacaaaaacgcccacgtcgggcgaaaaaaccggtaaacttcgagccggacagtgcgttccgtccagatgctgccgcggctaagccagacgataaagccttagctgagaagaaagccaaggcgaaggcaaaaagagcctcggctaagaccaaaaaaattgctgcggcgaccaaagccaagcgagcaaagaaaaaaaccactagcgatcagtaattagcgatcagtaagtaatggtggtgtgctacttgccgggcggcttttgtcgcccgcatataatttaattattggtgggtaagtcatattgtctgccaacacatgcaaaaagagcatcatgagcgaaattatttacggtattcatgccgttaaagccctattagaacgtgatccgcagcgtttcctggaagtctttattctgaaaggccgcgacgatcgacgtttgcaaccgctaatcgcagagctggaagccgccggtttagtgattcaggtggctagccgccagtggctggattcacaggttgaggggggcgtccatcaggggatcgtggcgcgggtacgtgaagggcgtcagtatcaggaaaatgacttacctgcactactggaaagtgtcgaaacacctttcctgctcgtgttggatggcgtcaccgatccacacaatctgggggcatgtttgcgtagcgcagatgccgcgggggtccatgcggttatcgtgccacgggatcgctcagcacagctaaatgcgattgccaagaaagtggcgagtggtgcggctgaaaacgtgccattgatcaaagtcaccaatttggcacgtaccctgcgagtattgcaggaacataacgtctggattgtgggaacggcgggtgaagccgatcacaccctgtatcaaagcaaaatgaccggtccgatggcattggtgatgggggcagaaggtgaaggtatgcgccgcttaacccgcgaacactgcgacgaactgatcagtattccaatggccgggagtgtttcctccctcaacgtttctgtcgcgacaggtgtctgtttatttgaagtcgtgcgccagcgtggattgaaagcctgatagcctagtcttgcggtcgacgcccccttcgttgtggttttactccgcagcctaaagccaacatctttgtatgttggctcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcaaaccaacatctttgtatgttggctttttgttgggaatttacgcaacctatcctaggctatcaggtgttttttcctgtttgtgacatacctgccagcaaaagcctccgcctgtaccatacttaatcctgacttatgaatattggttttcaggggagtcccgaaatggggaaaggtatggattggcagactcatttggttttcaatcagccggagcctttgtcgaacagtaatttgtttctgtctgacttggcgttgcgcgaagcggtagttcgggagcatgcgggttgggatggagagaatctctctttgatcggattacagcttggttcgttggaatcacttgaattgggtcggctggcaaatgcccatccaccagaattattacgttatgatggtgctgggcagcgcttgggtcaggtgcggtttcaccctgcatggcatgtcttaatgcaaggcctgatccatcatcgggtgcataaccttccttggcaggaagatgcgcggaacggctcctttgtggcccgtgctgcacgtttcatcctacatgcccaggtagacgcgggcgcgttatgtccgataaccatgacgtttggtgctatcccactgctacaacagacacttcctcctctctttcaaaactggttatcaccgctgctgtctgatcgttatgacccccatttgtccttaggcaatcagaagcggggtttactgattggcatgggaatgacagagaaacagggcggttccgatgtcttaagtaacaccacgcgggcagagccattaagcattcgtgggcagggtgaggcctaccggttgatcggccacaaatggtttttttcagtgccacagagtgacgcgcatttggtactggcgcaggctgagggcggtttatcctgcttctttctgcccaaaatactcccggatgggacccacaacgctatccgattagagcgtttgaaagagaagctcggcaactgctccaacgccagtagcgaagtggagtttgataatgccaccgcctggctattgggagaggaaggcgacggtattcgacaaatcctgaagatgggcggttatacccgctttgattgtgctctggggagccatgggttgatgaggcgcgctttctccgtcgccttgtatcatgccctacagcgtcaggtttttggtaaggcattggtagagcagcccttgatgcgacaagtattgagccgcatggcattgcgtctggaagggcacacggcgttactgttacgtttagcccgtgcatgggaggcttctggtgaggttcatgagcaaatttttagccgactgctgacacccgccgctaaatatcgggtgtgtgggcaggggagcgcgtttgtggcagaagcgatggaagtactcggtgggatcggttattgcgaacagagtgagttgccacggctctatcgtgagatgccggtgaacagcatctgggaaggctcaggcaatattatgtgtcttgatgttttgcgaacattacgcaaattgccaactgcggtcgagatgctccagcaagagttttactcggtacgcgggcagaatcggctgtttgaccgtgcctggcggcaactgcaacaacggctgaagaatcctaaagaagagcaagggcgggcgctgactcagcaactttttgacctgtgttgcgcttctcaactactgcgctttgcatcgccacggttagctgacgcctggtgccgaatgaccttggatcatcgtgaccaatatatgttgccagaggcggtttgtgcgcggttactggaacgtgcaacgggcgcacattaacgcgatagcaaacattatcgctacagcaaggccttaacgttacagcaaaacattaacgctacagcaaggccttaacgttacagcaaaacattagcgttatagcaaaacattaacgatacagcagagcattggcataccaaataccggggtagacactgtctgatatcatcacaatcaagtagtaaggtgccccgctggcattggccctgcgctgaatttcagtttcaacgtctcctgggctaccgtatacctgcgctgaaaccgtacccactttctgtaacctgaggctctgggcgcgggtgatttcttgtgcgtaaggctgaatggccggtggtggaaccggtgtgatgttgaaagcgttacaaccggacagcccgagagtgagcagcaagaaagctatcgtgcgttttatatttatcattcattgcctcttcgcagccattcaggcgtaacgccaagtaatcagggtatatatcttggaagaaattgatttaagactttatatctgagttttggcacactgcatttatccgctcctcttcacacttgaagtgcatgagcgttggtatccgttaatcgttgtttgtatcagttaatcaaggattgtggccatgattgagatgtcgctggaaaatattaatggtattgaggtgatacattctgcccctgtaggccaacgccagcaaccgttaccgaccattttcttctaccacggctacacctcgtcaaaagaggtttactcctatttcgcctatgctttcgcgcaggcagggtttcgcactatttcaccggatgcggacatgcatggcgcccgttttaatggcaatgaaacacagcggctatcccatttctgggagattttaaaatctaacattgatgaattgccagacctgaaacgacattatcaacaggctggattgattgagggtgaacgtattggggttgcgggtgcgtcaatggggggaatgacggcattgggggcatttgcccgctacccgtggatccgtgtggccgcagatttcatggggtcaggctactttacttcattggcacattcactgtttccgccacgggatgcaggtcgggagatcagccaacaggcgtttgagcgtcgcttggcaccattagcggattatgagctgactcatcagttagaaaaaattactgagcgaccactattagtttggcacggtgaggctgatgatgtcgttccagcggcggaaagtgcacgtctggtacaggcattacgaacccgtgggggtgataataatctgacctatcttaccgaagcggggatagggcataaaatcacccctacagcgctacgtgctggaagtgatttttttacccagtatttataaaatctccgtctctgatatagagggtgctctgattatttaaccgtgagccatcgaggtttgttgggggactgagaatgggtttgattgagccatcaaagaactcatttggtaatttagttatgattttattggtaaatttagccaaaaacagccctgtctccacgatcacgggtaatgaacaaaaaatgcggtttaagcttgctcatcgtcataacaggaataaatcccccgcagtccttgagtttccgacagcccacaagtatagttacgcgtcatttttcagccgcacacaaacacgttccttgcctccatgggccgcggttgaccctatcaggaggctgaataatccgtaaggagcaataatcgatgcgtcattacgaaatcgtttttatggtccatcctgaccaaagcgaacaggttccgggcatgatcgagcgctatagtgcaactatcactaatgctgctggtacgatccaccgtctggaagactggggccgccgtcagctggcttacccgatcaataaactgcacaaagcccactacgttctgttgaacgttgaagctccgcaggaagcgatcgatgagctggaaacaaacttccgcttcaacgacgccgttatccgtagcatggttatgcgcgttaagcacgcggtaactgaagcatcaccaatggttaaagcgaaagacgaacgccgtgagcgtcacgacttcgcgtcagaagccaatgatgattctgaagctggggattctgaagagtaattgccgtggtgaccactaatcgtctggtactttctggcactgtgtgcaagacaccggttcgaaaagtaagtccttctggtattccgcattgtcaatttgtgcttgagcatcgatcaacacagcaggaagccggatttagccgacaaacatggtgcagaatgcccatagtcgttagcggacagcagtcacaagcattaactcacagcataacggtcggcagtcagttaaccgttgaaggcttcattagctgccatcaaggtcgcaatgggctgaacaaattggttctgcatgccgagcagattgaatttatagattctggagactagccaaatggcacgttatttccgtcgtcgcaagttctgccgttttaccgcggaaggcgttgtagagattgattataaagatatcgctacgctgaaaaactatatcactgaaagtggtaaaattgtcccgagccgtattaccggtactcgtgcaaaataccagcgtcagctcgcccgttgtatcaagcgcgcacgctacctgtctttgttgccgtacactgatcgtcatcagtaatcggccactgtccattaacgactttgagaggataaggtaatgcaagttattctgcttgataaagtagcaaacctgggcagcctgggtgaccaagttaacgtaaaagcgggctatgctcgtaacttcttggttccacagggtaaagctgttccagcaacaaagaaaaacgtagagttctttgaagcacgccgcgctgaattagaagccaaattggctgacgttctggctgctgcagaagctcgcgcaaccaaaattaacgaactggtcagcgtcactatctcttctaaagcaggggatgaaggcaaactgttcggctctatcggtactcgcgacatcgctgacgctgtaactgcagctggcgttgaagtagccaagagcgaagttcgtttgccgaatggcgttctgcgtactgcaggtgagcatgaagttcacttccaagtacacagcgacgtgttcgcgaaactgaacgtagttgtggttccagaagcgtaagttacgcggctgtaacctgttaaaacgccagcctagtgctggcgttttgcttttggttatcggtatcatcgagatgctgaccctggcactaaaatatcaaatttgcagtattcaggtgccacatttgagcaggtgtaaatttcaaaaaagccccctttttcatattcccagtatggtttcccacggatggatgctatccaggttgtaccgccatagtacatatcgagctgtatgttttcggcttgcaaatcataagtgcatttttgaaactttcctgacccggtgacgttgtttccattgttctcaccttcaaccacgaagagcgcctcactgaaacgcttaataccgctctcttggggaagtggcccttgtaagataccaacccactcttcgccactagtcgccttcgccgtataaacgcctccgatcagcttaatcgcatcaattgccggacaatgctgttcagcaaatacggccaatggcgtgagtagtaacacaaaggataattgatatttcatcattactctctctccttataaatacggttatctgcctgcagatagcgataactatccaagaaataacctaatttgaacgagtgagagtgacaataataaagaagatcacagggtagataggggcagtaagccaacgtgacgattaatgttcgcgacgatagctaccatcgttttgtcgggaaaacagcacttcagtgttctctggggtttcaatcgccagtgcggtgactgcgccttgtgcatctagcatgatcttgacctcttgcccagccttcaggttactcagcggtttatcgctgccttcgacctgagccatggcaaaaacatcgttgactggcaggttattatcacggaacagttgcgccaacgttttacccgtttggacctgatagctctgccagtttccttgtgtcgtctcagaaggggaaactttgggggggacgggtacgtcattgttgtcctgtaattgggcctgtagtggcacgctggtcgatggggcgctaacggggaaggaaaggtcagtattatcacgggaagcgggccacagcagtgccagcagcaatacagtggtagcgataataaccccgcggcggtggaagaaaggcaacggctccatccactgaaaactgtccggcaggtgccaaatttttagccacagttctttaatgctctgaacgccttttctctgtgtgggcgctagcgcaggttctgtcacgttatcaggatccaccctctgttctggtgcattgatttcggatatcaggttttgctcatcagtattttttgcatccggtagaaccttctgcctaatggttagccaactgtgtagcagcggctgataaacccgattatttttccttctcctgggcgcgattctgcccatgctaacctctcttaaaataaaaatggatactgcagatggtcagcaggctcataggcttctaagtatatagcctgttaactctctagcccattaactctctacccattaactctctacccattaactctctagcccattaactccttggccgctgcgccatggctttggggagagtttactcacggactgatgcagaaagacagggggaataatgatacctaagcggggaattttccgttagctggccatcattgtttctttttcttcgacaaaagtcatcattcacgatgcaagattttaccgaactcccttgctgctgttatgcttgccgcttcaatttgattagtgactaaaggaaaattcatgacaaccccttcttttgatagcgttgaagcgcaagcgagctacgggattggtttacaaatcgggcagcaattacaagagtccggtctgcaaggtttattgccagaggcattgttggcaggtttgcgtgacgcgatggaagggaatacaccgactgtccctgttgatgtgatacatcgcgcgttacaagaagtgcatgaaaaggcagataaagtccgtgttgagcgccagcaggcgttggtagacgaaggcaaaaccttcctggaagagaatgccaagcgtgatgatgtgactaccactgagtctggtttgcagttctccgtattgcaggcaggtgacggcccgatcccatcccgtcaggaccgtgtgcgtgtacattacaccggacgtttggttgatggtacggtatttgatagctctgttgagcgtggtcagccagccgacttccccgtcagcggcgttatcccaggttggatcgaagcgctgtctatgatgcctgtagggtctaaatggaagctgtatattccgcacaatctggcttatggcgagcgtggtgctggtgcaacgatcccgccgttcagcgccctgatgtttgaagtggaactgttggaaattctgtaattctttggtaccgattatgccaaagggcgacagggggtcgccctttggcgtttatttacgataagaatatttacggtgagaataaatagttagtgagttattcgccccttagcgcacggggaaacagtaaattattttccagatgaatatgttccatcaggtcagtaatgaattcattgataccggtgtaaagcgcccgccaggtattacaggccccttctggtggtgtcacattttgtgtgagttgttttaccacgtctaattgctgcccaaccgcatcgtgctccgcttccatcacaaatattggcccactggcctgagaacccatgcctcgttggatcatcgggaacaggatctgctcctctttatacatatgttgagtcaactcttctaaaatcgcactgagttctgctgccagcccacgaggacaggtgggtttatcgccgtgtacccgttcaaccttttccgccatgagaaccagttctggtagctgctcacgatggcgatcatggtagcggctgatgataaaactaatgaggtttgtcagtggctgttgttgccaatcttcagatgagtgaggttcggtttgcaatgcactcaattgtgcttccagcgcatcaatatccagattcaacttattggcggcccgtaagagtgtttgtttgccgccacagcagaaatcgagctgatgttgacggaataactttgtggcccgaggaatagcgatagccagtgcgcccagagactgattgcggtaatccataatgacacctcattgagtaattatacatctataacatgcataataaatacatgttatagattgtgatataactccaagtgggtattatggggtaacggcagcgcacagtaaggcgctgccgccagagattactttctctgtaaatcgatttgataaacggcgaagccaacctcatccgtaccctgtactttcattgggtattgcgctttttgtttaataaaatcagcggccttagcagttggagaggtttcaaaacgaacatccaaaggttgcttgctatcaagggttgccagacgccaattgttgtcggcttgcgggatgacctgaccctttttcttggtttcagcactgatatatgcagacaggaccgctcgattttcgtcgggcgaagcgaatgcgatatggctgtcaccggtaccggcaaacttaccgctgtaagcgcggtagttattggtggcaatcaggaatgtggctttcggatcgataggcttaccgttaaacgtcaggtttttgatacgttcagcttggtcgttgattagcgtacattcgccatcgtaacgggcaggctggctgacatcaatttcatactctacaccatcgatgacatcgaaattataagtacgaaaaccatcccaattaatcaacgattgcggtttgctgctgttaatatcggtttgattaaactgtgcggcggaacactccagccactgcttaacctccgccccactggctttcacgacgacgagcgtatttggataaaggtacaaatccgcggcgttacggaaggtcagcttccctttttccacctcaacaaaactggtgggatcatttttgcggccaccggctttaaacggtgcagcggcagacagtaccgggaggtcagctaaatcaggatcgccctgaataaaatgttcggtatacgcgcgctgggcgttattcacaatctgcacggtggggtcatcttggatcagtgccagatagctgtacatgttatctgatgcttcaccaatcggttggctgacaaaatcacgggtgctctggtgatcaactgccagtacttccaccagtttggcattttctgccgccagtgatttttgtgctgttttatcgtagataggacgggcttcagccttggcatcgataacttgccattttccctgatcattattcaggacaaaatcgactacgcctaaatggtcaccccattggccaggcatcactgccggaataccgtttaaggtaccttgagtgatatccgcgcctttgatggcggcaaaatctttgctggggaacacaccatgtgcgtggccgaacatgatggtatcgatacctggaacttgactgaggtaataaaccgaattttcagccatggttttataaggatcgctggaaagaccagagtgcgggatagcaacaaccagatcagccccttgctcacgcatctccggtacccacttcttggcggtttcagtgatatcgttcaccgtgactttgccactcagattcgctttatcccagatcatcacttgaggcggtacaaaaccaatgtacccgatccgcaggttatggctctttccgtcacgatctttcactggggtatcgatgatcaggtaaggctggaacaagggtttacctgttttaacatcaatcacgttggcgttaacatacgggaatttcgcccctgccagtgatttcttcaggtagtccagcccatagttaaactcatggttaccgatattgccgaccgcataatccagcgtgttcatcgctttatagactgggtgaatctctccgtcgtttaaccctttagccgcgatataatcaccaagcggactcccctggatcacgtcaccgttatccaccagcacgctgttagtggcttgttgccgggctgcgataatcaagctggcagtgcgtaccagcccgaatttttccgtgggtttatctttgtagtaatcaaaatccatcatgttgctgtgtaggtcggtggtttccaatactcgtaaatcaacagtggcagcagacagtgatgtcgcgacagcaatcaggctggcaaggagggataacgtcagcggacgcttgaacatggctttctccatcgtgggtttccattaaaaacgctacccttcgtacttggtgtatattcgatatgtatcgcaaaagaatatgtaattttaattaattgctaaagcaaagtgtgaagtttggcagaaaacttaatcagataacgcgtagacgctcacagttgcggtagatgaatcccactgattttataagtactttcctgacaaatatggctatttatcaggaatattattagtcttcagattgatgatcagtcttgagtgttcagcttttattttggctctgcgttctaaaataattggcgttctaaaatagagagagatccggtgagggggggcgcaagagctactcttactccaagagctacagttactccaagagctacagttaactcaagagcgacaattaatttggtgcgctctgatgagcgatattttacataatggataataccaaggggggatgatgttagagcaaattggccagttggcccgtgaggcaggcgtggcgattatggcggtctatcagggcgacaaaccccttgatattgcgcataaaaaggatgattcaccggtgacggcggctgatttggcggctcaccagattatcaaagctgggttggcgcgattaaccccggatattccgctactctctgaagaggatccacccgcttgggatgtgcgccaacactggcaacgctactggctggttgacccgctggacggtactaaagagttcctcaatcgtaacggtgaattcaccgtcaacatcgctttgattgaccaaggtgaaccggtactgggagtcgtctatgtaccggtaaccgaagtgatgtacagcgcggcaaacggacaggcttggaaagaagagtgtggcagacgtatgcagattcaggtgcgtgatgccctgcctccgttggtcgtggtgagccgctctcatagcgatgctgaattggaagactatttatcacaactgggggagcatcaaactatttcggtgggctcatcacttaaattctgcttggtggcggaagggaaagcgcaactgtacccgcgttttgggccaactaacgtctgggatacggcggctggtcatgccgtcgccatcgctgccggggcgcaagtacacgattggcagggaaagacactgtcttataccccacgtgaatctttcttgaaccccggtttcagagtttcgttattttagcgttattgctgcacaagttggtgcagttggtcgatgacctgctgcacctctgctgatgtcagtgctccatcttttacaaatttgacatttccttgtggatccagcaccacaatggcagagcttttctccgttaacccccaagcttttgccacatttcccttactgtcgataataaattgcgaccaaggaaattcacgtttactgctttcaatgctgttacgcacaaacatggctgtcccgatgattgcatcatcagtattgacgatggtcgtcgtttggtaacgttcgcgtggcagattggcttgcttgatggcatcaatcagcggggcattcatttctttggctgaggtacggccagcaatgtgttgaatgacgcgggttttgccgggcaattgtgagctattccagtttttatagttaaactgattggtggtcttatcataatccaactcacctttatcgcggacaccaactggcggcacgcgttggttgtcctgaatgttatgggccgataccagtagcggtgtgaatatcagcgatattataagcaggctattttttatcatattatgtccttgtagagatatccgcgtagataatgacgtagggcacttacccctgaaagtaggtaagtttttcaataataggtccagatcagaggtctgtcctgtttagtagtctaattaatttctaataattattagaaggttattctgttgttaagtctcatttttgctgcctgattctgtaatattatgtaaattcagcatctatgactgattctggaggaactaagcgccatgcttcaaatctaacattgagcaattatcttacgcggcctgtgatcttggtcgctaaggttcgaaggggagtattgatgtgatgggaggaaaatagaacaatgaggatcttccagcgttataacccggctaaagttgccatgtatgtcaaaacgttattccgtggtcggttgtatatcaaagatatgggggcttttgagttcgataacggtaagattttagtcccgaaagttaaggataagcggcattttgaagtgatggcggaggtcaatcggcaggtgttacgtttgcaggccgataccctgctgacttgaagccgcagcattgttagcggcatttgcccacctgagcagatttaatcacggccccaactcaggggccgttatgtttaccgtgatcacgatttattcatcagcggcggctaggcgtcactgctttcgtgtggtgcttttggcaggattggcgctggctggtcactgagccttgtcaccagtagctgatctatcttgtagctatcaatatcgacgacttcaaatttgtaacccgcatatttaacaaaatcagttcgtttaggaattttacgcagcatatacatcataaagccgccgatagtttcataattgcccgattgcgggaaatcgtcgatatgcagtacgcgcatgacatcttcaatcggtgtaccgccctcaatcagccatgaattctcatcgcgggcaacaatttgctcttcctgcccttggccaactaaatcgcccatcaacgtggtcattacgtcattcagtgtaattatcccaacaactaaagcatattcgttgaggatcacggcgaagtcttcacccgcggttttaaaactctccaacgcttctgaaagtgtcaatgtatctggcacaatcagagctgaacgaatttgtacgccactgctgagtaccagactttggttacctaatacccgattcagcaagtctttagagtcaacgtaacccaccacttggtcaatgtgaccatcacataccaggaattttgagtgcggatgtgtggagattttatctttgatactgtcttcgctttcccgtagatcaaagtaaatcacgttttcacgtgaagtcatggaggaaggaacggttcgagactccagctcaaagacgttttcaatcaactcatgctcttgcttgcgtagcactccggcgagcgcaccggcttctaccacggcatagatatcatcggaagtgatgtcatcgttacggaccatgggtaatttaaataggcggaagataagatttgccatcccattgaagaaccagactaatgggcggaagatcattaggcagaagcgcattgggttgacgatccggacggcaaccgcttcaggtgaaatcataccgatgcgtttcggggttaaatcagcaaacagaataaataagctggtcactaacacgaaagaacaaacgaaactggcttgatcggccaactcaggagccataaaacgctcaaaaacgagtttgaacgaaggggagaaagcggcatcaccgacaataccaccaagaatggcgacagcattcaggccaatttggaccacggtgaagaacattcctggcgtctcttgcagtttcaggactcgtaaggcgttggtatcgccctcgtccgccagcagttttagtttaattttgcgtgaagccgccaatgaaatctctgatagcgagaagaaggcgctgaccgcaattaaaaaaagaatcagtaagatactatttaacataatctatccgtgtcgtaccgacgatagcgccggcgatcataaggaagggtcacacaattatcttgtttcagtatatcttttaaatattaaggcattatatcaaaacccagacacagcttaggtacagaacaaggtctctataaagcccatgattgtgtacagaacagggtttgaattcaagctaatggcagaaagtggttattgggctgagtgaacagcccggacagtatagcagcagcgatgggagatagcagcagcgatgagcgcactgccagccttacacgttaggcggcagacaaacgccaatacccccaagaccacagtatccatgaggatttttgtgcaaatattgctggtggtcatcctcggcatagtaaaacggcagggcaaccgtaatttcgctggtaatcacccgttgatcaccggctttttccatggcttgttggaaccgctcccggctcttgtgagcttgttcttcctgctcgggggtcaggacataaatagccgagcggtattgtgtcccgacatcaccgccctgacgcatcccttgtgctggatcgtgattttcccagaaaatctgcaatagctgctgatagctgatgacggcgggatcaaaaacaacacgaaccacctccgcatggcctgtacgaccactgcaaacttcatgataggttggattaggcgtgtgaccaccgctgtaacctgctgcggtgctatagacgccaggctgttgccagaacaagcgttcggctccccagaagcagcccatggcgaagaaggctaggtccatcccctccggtatatacgtcatggaatgaccatgaacggcatggagaggagagaccggtattgatgtcagtcgccccggcaaggcattcgccgcatcaatgacggcggtattatcaacgttttgcataaaaaaacagactccgaggttgacagtaaattagatttttacagtaaatggataacaagatgtttacagtgaatcactatagatagttgtatctgattgtgagtttgcacacaataagagtcattctgcgttaatctaactacttagcagggaattttagggttacaggcttaaatcgtctttaagcttagaggattattgtgtgagtaacgccactctcctctgaaacccttgagcgtgtttgacaggaacgtaaaattaatcaggagtacgcgtgctacgataccctattctgtgttttatgtgtctattgctcgccacacctatcgcctatgccgccaatgtgcggctacaggttgagggtcttagcggtgatttagaaagaaacgtcagggcacgtttgtccacaattggcactgatgaagttaccgcagatggccgttttcgttcacgggtcgatgaagctattcggcaggggctgcgcgcattaggttattacgatcccaccattacgtttgaattacaaaaccgcccggcacccgcacgttcagtgttaattgcaaaagtggttcctggcgagccggtattgattgccggtgtcgatatcgtactgcaaggcggtgcgaaaacggatcctgattatcaggcactcgttcgccgtgataccccgaaaattggctcggtcctcaaccatggtgattttgataatttcaccagttctcttactggtttagcgttacgccgtggctatttcgacgccaatatgatcaaaagccagctcggtgttgccgctcaattacacgaggcgttctgggatattgatttcgacagtgggcaacgttaccgctttggtaaggttattttccaaggctcacaaatccgagaggattatctgcagaatttagtgccgttccatgagggggaattctatacctctgatgaactggccgagttgaaccgccgcttggcagccaccaactggtttaactcggtggttgtttcgccggatttccaagatgccaaagagagtaaaattttaccgcttgatgcggtcgttaccccacgcactgagaataccgtcgaactggggggcggttatgcaaccgatgtcggtccgcgtctgaccgccagttggcgtaagccttggatgaactccttcgggcatagcttaaccaccactaccgcgctttcggcacctgagcagacactggatttcagctaccgtattcctttattgagaaaccccctcgagcagtattacctgatacaagggggctttagacgtaccgacttaaacgacactaattcagataccacgaccttgaacgttgcacgtttttgggatctctccagcggctggcaaagggcgattaacctgcgttggagcctcgatcactttacccaaggcagagtcacggataccacgatgttgctgtatccgggggtgagtattaatcgtacccgccaacgtggtggggcgatgccggtctggggggatagccagcgctattctattgatgtgtctgatacgacttgggggtcggatgttgattttggcatctttcaggcgcagaacgtgtggatccggaccttaggtgagaaaaatcgttttgtggcgcgtggcaatgtggggtggatcgaaaccaataattttgaccgtgttccaccgtcgctgcgtttcttcgccgggggcgaccgcagtatccgtggctataaattccgtaatatttcaccgcgtgatagtgacggaaaattaaccggggcttccaagttggcaacgggctctcttgaatatcaatataacttcacgggtagatggtggggggccgttttcgtcgattcgggcgaggcggtgaataatttcagcaagagtgacttaaaaacaggggcaggtgtcggggtacgttgggcatcacccgttggaccgatcaaactggatatcgcggcaccaataggcgataacgagacacatggcgtgcaattttacatcggtttggggcctgaactatgaagtgggtaaagagactcagtattgcattcttgctgattatcctgctattggtcggtgctctgggggggttactcggtacgaccagtgggttacattttttaatcaacagcgccgcccgctgggtacctgggcttgatattgccagtgttagtggtggctggcgtggtctcaccttaacgggcattcagtatcaaatgcccggcgtcacggtcaaagctgggcaattttatctgtcattgcagctctcttgtctgaagaatagtgagctatgtgttaacgcactgacagcacaaaatattgatgtggtggtgaatactcaagcgatgccacctacgtcatccacgccagccagtactgaccccatgggggaactgagtaccccatatcccattttcttacgtttgctgtcactgaataacgtcaaagtgaccattgatgatacggctatttcactggatgaattccgtactggtgcgcattggaagcaacgttcattggctttgatgccgacaaaaatcaacgggttattgatcgcattacccaaaacggtgtcagccggggttcccgatgcggtgaagcctgcggttgaaactgctatggccgccaaagaggcggttgcgcaattatcagcggctcctggacgatcagccacagcatcagggcaatcaaccactgcgtcaggacgatcagctactgcgtcagggcaatcagctactgcgtcagggcaatcagccactaccgggggtcaactggctacggtcccagcagaaccggcgaccccactgggtgaaagtttaaaagcgctatttgccaaaccattgctaccggcattgccggacttccgtctaccgctggatttgcagattgaagagatctcagggcaacagcttaggctgaccggggataacgaggtccttatcagcagcttgttactgcaggccagtacacaagatcaacggataacactggatacgctggagatcaaatcgccgcagggcgggttgtcggcgcaggggcaagcgacattggcggataagtggccgctggatctggtggtcaatagtgcgttgaacattgactcgctgaaaggcgaaaaagtgaaattgaccgtcggtggggcgctgcgtgaggaactcaaggtcacgctcaatctgtcagggccggtcagtgcgcaactggagacagaaacgtcgctggcaaaggcaggtttgccgttgtcgctgactctgcagagcaaacaactgcgctggccgttgactggcgagccccaataccaaatgaataacctcaggatgcgcctcaatgggcaagcgacggattatgcgctttctatccgttctgatatcaaaggtactgatctaccgccagcggtattcacgctggagggtaaaggcaatgttgagcaatttaatctgacgcgtttacgtctggcggcgttgcaaggtcacactgacctgactggggtagtggattggcggcaagcgatcagttggaattcggtactcaccttatcgggcatcaatacggccaaacagtggcctgaatggccagcaaaattggagggtaagattgttacccgcggcagtattcatggcggtagctggcaattgcaggttccggagctggtacttgatggcaatgtgaaacagaatcgcgtgaccgcccgcgggtctctgaccggtaatgcggcgggccaatggcatattcctggtatcaatctggcgttgggccgtaataagcttgatatgaaaggggagttgaacgacaactggctgttggatgctaatgtcgatgcgccacaacttgatggcgcgttgcccggtctgggtggtgtagtgaaagggtcgctgaaattacgcggtaacctgaaaacgccgcaactgctggctgatctcacggctaaccgcctgcaatggcaagagttgcacatcaatcgtattaaagtggatggcgatgtccgttcgacagatcaaattcaaggccagttggcggtcagagttgaacagcttaagcaagctgattttgtggtcagtttgttgacgttggatgcccgtggcagtgaaaaacagcatcagttgcgtctgaatatgcaaggggatcctgtctccggccaattgtcgctggagggcagcttcgacaaacaacaacagcgttggcgcggtactctcaataacacgcgctttgataccccagtgggggaatggcgtttaagccgtgcaatgacactggattatcagaacagcgcgcaacggatcaccatcggcccccactgttggcttaatcccaatgctgaactttgtgcgccccggccaattgaagctggccccagtgggcaggcaagtgtggtactcaaccgctttgatttagcgatgatcaaaccgttcctcggcccggataccaccatgaacggtgtgtttactggccgggcagaggtcagttggaaagagggcggtaagttacctgatgtgcgggtatcactcagtggtaatggcgtgaaagtacaacaaatggtgcagggcagcccactgccgattgcctttgaaaccctgaacctgaatggcgggctggcgaatgggcaagtgcgcgccgactggttggtcaagctcgtcaataacgggcagttctctgggcaggtgcaagttgcagacccagaagggcggcgcaacttatccggtaatgtagccataagtaatctctctctggcgatgattaacccgattctgagtgatggtgaaaaagcggctggcatattgaatgcgaatctgcgtttggcagggaatgcgaaaagtccgctcgtctatggccgcctggcactggataaggtggatattgatggcagttggatgccattcgatatcaccgaagggcgcttggcgatgaattttgatggcatgacatcgacgctggaggggttgatacggacttcccaagggcagttgaatctctccggcgatgcggactggcgtgatattagcgcctggcatgccagagttgcggccaagggcaacaagttacgggttacgatcccgccgacggcgcgagtcgatgtttcaccggatattgttttcgaagccacgccgcagttatttacgctcaatggttcggtcgatattccttgggcgcgcatcaccgtgcaggaagtgcctgaaacagcggttggcgtctcctcgaatgaggttatgctcaatgaccaattgcagcctattgcgccacagagcgccagtattccgatcagcagtaatttggtgattcggatcggtaacgatgttcgtttgaatgcatttggtttgaaagcccgcttgcagggcgatttgagaatgatgcaggatcagcgtgggttagggctgaatgggcaaattaatattccgtccggtagcttccgcgcttatggtcaggacctcatcgtcaacaaaggaatattgctgttctctggcccaccagatcagccgctacttaatattgaagcgatccgaaatcctgactctaccgctaatggtgttattgccggagtacgtgttacggggatggcagattccccgcgcatggaggtattctctgatccggcaatgtctcaacaggaggccttatcttatctgttgcgtggccaggggcttggcaattcgggggctgacagcagtatgatgacctcaatgttgatcggcatgggggtggcacaaagtggtaaattggtgggtaaaatcggtgaggcatttggtgtcagtaatctggcattagatactcaaggggttggtgatagctcacaagtggtcgtgagtggttacgtcaccaaagacctgcaaataaaatatggtgtgggtatatttgactcactggctacgttaacgttacgttatcgattgatgcccaggttgtatctggaagcggtgtctggtattgatcaggcattagatttgctttatcagtttgagttttaaccatgcgaattattgtttacggcagtttacggcgcaaacaagggaatagtcattggatgacggacgctcagttactgggtgaacatgaccttgaaggctacgaaatgtacaatttaggccattatccggcggttatccccggagacggcactgtgcattgtgaagtttatcggatcaactcttcaattatgaatgagttagatgagcttaaaagtaatacgaaggactatcgacgtgagttgatcaagacgccgtatggcagtgcctggatatatctgtatcgcttgccgacagagggtttaccacgcatttacagcggtgactggctaaagcgccatgaagagattgataagccgtaaaaagtaagcagtaacaaacaaggtaagcagtaacaaaaaaacaccgcacaaggtaaacggccctattttggggcctgttcacgataggcggtgtttttttataggcgatacgcagaactatttcttagcacgctcgaaagaagaaaggatttcagctttggcggctgcggcatcttcccagccgtcaactttcacccacttgcctgtttccagatctttgtaatgctcaaagaagtgtttgatctgtgctttcagcaattcaggcagatcctgcacgtctttaacgtgatcgtactctttggtcagtttgctgtgtgggactgcaaccagtttggcatcttcgcctgcttcgtcggtcattttcaatacgccaaccggacggcagcgaataactgaacccggctgcaacggatacggtgttggtaccagcacatcaaccggatcaccatctaatgacaaggtgttattgatgtaaccgtagttgcatgggtagaacatggccgtggacataaaacggtctacaaacagagatccggtttctttgtcgatttcatatttaataggatcggcattggcagggatttcgatcacaacatagatatcttctggcaggtctttacctgcgggtacttggttcaagctcatgtcggtttccttttatcaaaccagaaatggagtgctggctattatagccaagtcttttatgaattcctgtccttttcattgtcagatgacgttgagatagccagaggtagggctattttattccgttagaaataaaaaacagcggcttaaaaggccgctgttagcttatttttgaagggagcgacggcattactgcaagttacttggcttcttcatctgggaatttagcgataaacccttccgcatcttccaccatggattttgttcccacgaagaacggtgcgcgttgatgcagtttctctggcacgatgtccaggatacggttcaccccatcggtggctttaccaccggcttgctccgcgaggaaggccattgggttgcactcatacaacaaacgcagtttcccttgagggtggctggcggtacttgggtaaatataaataccgcccttcaacaggttacgatgaaaatcagcaactaatgaaccaatataacgggaggtatatgggcgcttagtggcttcgtcttgctcctggcaatacttgatgtattttttcacacccagagggaatttaatgtaattcccttcgttgatggaatacatgcaaccggttgcgggatagcgaactttttcgtgggataaacagaaaacacccagagaaggatcgtaggtaaaggcatggacaccgtaacctgtggtatagaccaacatggttgaggaaccgtaaacgacatagcctgccgcgacttgtttggtacccggttgcaggaagtcttcttcagtgattggtgtcccaaatggcgtaatacgacgataaattgagaaaattgtgccaacagaaacattcacatcaatatttgaagaaccatccagtggatccatcaaaaccacatacttggcattttctgctcttccgccatcaaaaatgacaatgtcatcttcttcttcggaggctataccggcaacttcaccacgggctttaagggcagctttcaacttttcattggcaaacagatccagtttcatctggtcctcgccctgaatattggaaacgccgctggcacctaagatatcaaccagacctgctttgttgatatcgcggtgaatgatctttgcgccgagtttgattgctgaaagtaacgcagttagttcgccagtggcgtgagagaaatcgagctgtttctcgacgatgaattcgcctaacgttttcatgacacaatccctgaatctacggttaaatatcgatttattaatacacaacacagctaatgtcagcagtgtagcccaaaggtaagattgattcataggcaattccatttcttctctttgattctgagcggtagaatggctacaaattttaagcttattaatacggaagatttatgcgcattcacatcttaggtatctgcggcacatttatggggggcttggcgatgctcgcccgatcactggggcatgaagtgaccggagcggatgctaacgtgtatccaccaatgagtactttgcttgagaatcaaggcattgacttaattcaaggctatgatcctgcccaactgaatccaataccggacctggtgattattggtaatgcgatgactcgcggtaacccgtgtgtagaagcagtattggagcaaggcattccatatgtttcaggcccacagtggttgcatgaccatgtgctccccgagcgctgggtgctggcggtcgcggggactcatggtaagacgacaaccgctggcatgctggcttggatcctcgaagcctgcggttatgaacccggtttcgtgattggtggggtaccgggtaatttcgatgtctctgcccgcttaggtaatagcccattttttgtgattgaagcggatgaatatgattgtgccttctttgataagcgctctaaattcgttcattacagcccacgcaccctgatcatgaataaccttgagttcgatcatgctgatatttttgatgatattaaggcgattcaaaagcaattccatcatctggtccgtttggtgccagggaagggtaagattattttgccggataatgataatcacctgaaacaagtgatggcgatggggtgctggagtgagcaagagctggtgggcgaaaccggcagttggtttgcccgcaaagtctctaccgatgccagtgtttatgaagttttactcgataataatgtggtcggcgaagtgaactggtcattggtgggtgagcacaatatgcataatggcctgatggcgattgcggccgctcgccacgttggcgtgctaccggctgatgcttgccgggcattaggtgattttattaatgcctcccgccggttggaactacgcggagaagcgcatggtgtcacggtttatgatgattttgctcaccatcctaccgctatccttgccacgctggcggccctgcgcagtaaagtcggtggaacagcacggattctggccgtactggagccacgctctaatacgatgaaactggggttatgcaaaaatgagctggcaccttcattaggtcgcgcggatgaagtatttctgttccagccgcagcacattccttggcaagtggttgaggtagctgaagcctgtatccagccagcgtattggagtgctgatatcgatcagttagttgatatgattgtgaaaacagcacagcctggcgaccatattctggtgatgagcaacggtggatttggcgggattcacgataaattgcttagtgcattggataaaaaagcagaacaagcaacggcactgttggattaggctggataaaatatcccctgcaagtggggggagtgtgccgggaataacgacgaaggatacaaatcatcatcttgaaaatatgccccatgttaatggggcattgcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcattggcggttattatttacacttaatcttatttgtaaatattagcggtggcatgccaattattctctgaacgcacttcaatcactttatacgctttcgcacccacggtatctgctttatcagataaggcctggcggatgtcagatggtgcgccattaaggccactgacggtaattgttcccataggttgcaactgagtcgcttgattctcattaatagaatctgctgcaaaaacaccaaatgataatgcagatagaatgctcattgttgcaacagtcgttttaatattcatattgttacctcggtatattctttcatcactttacataaagtgtgacttacgtcactaaatagagtgtacgcttaacaactaaaattattaatagcctggtaataataattattgtcactttaccgtatgttactatctttttaagaaccaaaaggaataataagcggcgaaaaaacaagcttaattgataaaaactaaatactttcaattgaataagtgattttgactaaacgtgcgaactgagacagtagcttcagccactgatgcaataaaaagtaagcatattgagggtgaaggctatgataggcagtggaatacgccgtctggcgagggtgagataatgcggcacataaggccgcattttactgctcggtgtttaagcgggacgttaaagctcttgttcgaatagcctgagaatagcttcgtgcagttgtttaacggtaaaacctctggcgggcgtggtgaaaatagtatcatcaccagcaatgctacctaagatcccctctgctttacctaatgaatccagcaagcgagcgatcaactgagcggcacctggactggtattaatgacaacgactgaatcattataatctacatccagtaccagattcttgagtgggctgctggtggtcggtacccccagttctgcgggtaaacagtaaaccatctccattttggcattacgcgttctgacagcaccaaactttgtcagcatccgagaaaccttggattgattaatgttttcaaagccttcttcctgcaaggccaaaacgatctcgccctgagaactaaacttctcttctttcaataacgctttaaacgccttgataagatcttcttgctttgcgggattgcgcatctgttatgccttgagcagtaaaaagggaataagattattatgcatataaatgaatttttattcaacatggcagtaaggcattgtctggaaaagcactgatatcaaggtacagaaaaattttaatatcacttttttgtcacaattatgctaaatcacttttcattcttattctgcgatagtaatgagaatgttattaaaatgatgttgttctgatgtaacagaagggtgtaatgtaaccgccggttaacttgtcataaatatatttgtaaatattagaataatgtgcgctatctcattaattaataagcgatttaatctaaaatgtacgaatgttatgcacctttttgatgcgtgatatctcactctagctgttaatttattgtgtttaaaatcacaataaattaaggtgcataactagatgaattcacggcaaatttaaattaaacataataaggagtataggatgaaagttgcagttctcggtgccgctggtgggattggccaggccctcgctcttctactcaagacccagcttccttcaggttcagacctctctttatatgatatcgcgccagtaacgcctggtgttgctgttgatctgagccatatccctacagccgttaacattaaaggcttcagcggcgaagatgctacaccagcccttcaaggggcagatattgtgctgatttctgctggtgtcgcacgtaaacctggtatggatcgttcggatctgttcaacgtcaatgcgggcattgttcgtaatctggttgagcaaattgcacgtacttgcccgaacgcattgattggtatcatcactaacccagtcaacacaaccgtcgctattgcggctgaagtgctaaaaaaagcaggcgtttatgacaagaataagctgtttggtattaccactctggataccattcgctccaatacctttgttgccgaattaaaaggtaagcaaccccaggatatcgaagtgccggttattggtggccactctggtgtgactatcttgccattgctatcacagatccctggcgttagctttacagaacaagaagttgcagatttgaccaaacgtatccagaacgcgggtaccgaggttgtagaagctaaagccggtggcgggtccgcgacgctgtctatggggcaagctgcggcacgttttggtctttctttggtacgtgccctgcaaggtgaaagcaatgttgttgaatgctcttatgttgaaggcgatggcaaatatgcccgcttctttgctcagcctattctactgggtaaaaacggtgtcgctgaacgtaaagatatcggtaaactgagtgcttttgagcaacaagcgctggaaaatatgcttgatgttttacacaaagatatcgagttaggtgagaagttcgttaatcaataatattcccttcggccttgacgttgcagggggttagctgcaagcgttactcggcccatccatgggcctcgcttctgcgaggccgctgcaagccgcgttcaaatctgctcccggcgctaagtgtcaataacagttgtcacccgaatcacttactggtcgttgaccttagataaatagactcatcgggactatgagcctcatcagaggctcatcctgcgggccagcgctgttcaaaatggttgaaccaatttgtcgtttactggctgcctacctgcaatgccatgactttggatatagagataaaaaggggctactgaaaagagtacgaacagtagcccctgatattgtaatgatactgcccgtcgttatgagatttatcggcggtgtaataagacgttcaccccccaccctgtgagcggtaagctgatgggtttttttatggctgcgttgtggttggtcgtatccttactttgcgatcaaggagattccctgtcttggggtcaaaataacgtgttggccagatctccgaaggatgaatatccagacactctgcaatcaaccactcgcctttcggccaaggtcgcgtcaatgcattggcgagcgtagaagagcttaatcctgccttgcgggaaagggctgccagagtcgtacctttcttacgtagtgcagcaatgatgtcggctgggtgccaatcagatttccttaaaatcatctttaatcctttttttttctaagctgctgacgtgttagtgatataaataacggtacatcgttaattatacagtgaacaaaaagcaatcatttagaaagataatatcatttattttcccaaaaaatttaaatgttttctaaaaatttcttttttgtgtctcaacgcatagtaggaagcaacgctatgaaaaaagagtggtttgccgctaaggaattggcaggtcttgagggactaccttcatcaccacaaggaataaacctcatggctaaacgtgagggatgggagcaacgtcgccgccggggagttcagggaaaggctgttgaataccatattggcagtttaccaatcacgattctgaattcattacaactcagagaagagcctgctcaatatgccacgacacggcaggatccgttaaccctctgggtcgaagcttactatcgttttacagaggctgaacgggaacaggttatcagctttattttccgtgaaggggctaaaagccttatcgaacgtttggaaatggattaacccgtgggtaaagataggatatgaccgcgcttactcattaatgggataaacccggatggtgaatccgggtttctaaataatttccataaactataatcaaaaacggcggtgcactgagatatgtgccaagccttcaagggccagacgataatcactttcaggtaacgcgtgcaatgcggcaatcgctttatctgcttcttcttcagcacgctgacgggtatagaccagagagccacaatgctccatggcagccagcactggttcgagtaaatgacggccattcccctgttcaatcgcttgccggatcattgcggcttgttctggggtgccattatgcatggcatgtagcagtggcaacgtcggtttaccttcattcaggtcatcccccgtatttttgcctaacgtggaaccctctgcgctgtaatccagtagatcatcaataagctggaaggcagtccccagataacgaccatagttctgtaatgccagttcctgctcctcactggcatctgacaatattgcggcagattgtgcagcggcctcgaataagcgtgctgttttgctgtaaatgacctgcatatagctttcttcagtgatgtctgggttattacagttcattaactgtaatacctcaccttcggcgataacgtttgtcgcttcagacatcaatgtcagcactcgcattgattgcagccctgtcatcatctggaatgagcgcgtataaatgtaatcgccgaccaatacactggcagcgttgccaaatgcggcattggcggtcgctttgccacgccgcatatcggattcatcgacaacatcatcgtgtagcagtgtcgccgtatggataaactcgatgagtgccgcgacggtgatatgcttgctaccctgatagttaagggcccgggccaccaagaccgcgatcattgggcgaatacgttttccaccaccgctgataatgtaatgacccaattgattgataagaacaacatcagagttcaattggtcgagaattgttgtatttactgccgccatatctggcgcggttaactcgataatcttttctaggttcattgttttattcagctgttcttctctttaactacgatgagattaccgctcacattattacatgacgttctctgagaccatgattgtacttgaaaaatgcatcaaataaatgagatgtaataaactgtgctttttttcttctctcgtactgattatatacttgtcattcgctacatttttgcgtagaattcgcgccctattgtgaatatttatagtgcgctctggactacaaaagtggagtgcgcggaaagcggagttttatatgtacgcggttttccaaagtggtggtaaacaacaccgagtaagcgaaggtcagaccattcgcttggaaaagctggacatcgcaactggtgaaacgattgagtttgaccaagttctgatgattgctaacggtgaagaaatcaatatcggcgctcctttagtcgatggcggcaagatcaaagctgaaattattgctcatggtcgcggcgagaagattaagattgttaaattccgtcgtcgtaagcattaccgtaagcagcaaggtcatcgtcagtggttcactgatgttaaaatcaccggcatcagcgcttaagatttaggagagcggataaatggcacataaaaaggctggtggctcgactcgtaacggtcgtgactccgaaagcaaacgtctgggcgtaaaacgttttggcggcgaagcagttctggcaggcagcatcatcgttcgtcagcgtggcaccaaattccatgcaggcatcaatgtaggttgcggcaaagaccatactctgtttgctttggctgacggtaaagtcaagttcgaagttaaaggcccgaaaaaccgtaaatttatcagcatcgaagctgaataagtttttcgcgtcctgtaaatagatgtaagccctgcaatttcgttgcggggctttttacatttctggctcgaccccacctggtaaaaaatggatacgaaacagcaggctggtttaggtatttttctggcactaaccactgccgtattctggggtgctttgccgattgcaatgaagcaagtacttgaggttatggagccgtttaccatcgtctggtatcgcttcatgatggcggcgattggcctggggattatcctggcttcacgtcgtcagcttccctctcttaaactttttcgccaacgtcgctggctagcattactgatcattgcgacctgtggcttgctggggaatttcatcttcttcagttcatcattacaatatctaagtccgacgacgtcccaggtcattgggcaactctcgccagtcgggatgatggttgccagtgttctggttctaaaagagcggatgcgtatcacccaagtgattggtgcgggtatgctgatttgtggtctattgttattttttaacaccagcctacatgaaatttttacccgcctgacggattatacccttggcgttgcattgggcgtctgtgcagcggtagtctgggtaagttatggtgttgcccagaaggtgctattaaggcgtatggcatcgcaacaaattctattattgctgtacactttatgtgcgattgcattgtttccactggcgaaacctgctgtcatttttcagcttagcgggtggcagtttgcctgtttactgttttgtggtgttaataccttggtaggctacggtgccttggctgaagctatggcacgctggcaggcagcgcaggtaagcgcactcatcacattgacgccattgtttaccttgtttttttcaattttattggcgctggcttggccagatatgtttgccgcaccgtccctcaaccttgtcgggtacgcaggtgcattcgtggtggtggcaggtgcaatgttttccgcaattggtcaccgttggtggccacgtcggacagaaataaacctggttgctttgcaaaagcagccggtgaatgatttacggagaaagtaaatgaagtttgtagatgaagctgcaatcctggttgtagcaggtgatggtggtaacggttgtgtcagtttccgccgtgaaaagtatatccctaacggtggccctgacggtggtgacggtggtgacggtggcgatatttacctgctggctgatgaaaacctcaacacactgattgattaccgttttgtaaaatctttccgggctgagcgtgggcagaatggtcagagccgcgactgtacaggcaaacgcggtaaagatatcaccatcaaagtcccggttggtacgcgggtgctggatcaaggcacgggtgaaattgtcggtgatatggtccgtcatggccagcggctgatggtggccaaaggcggttttcacgggttgggtaacagccgtttcaaatcctcggttaaccgggctccgcgccaaaaaaccatgggaactgaaggtgaaacacgtgagctgatgctggaactgctgttattggccgatgtgggtatgttgggcctacctaatgccggtaaatcgacatttatccgcgcggtttccgccgctaaacctaaagttgctgattatccatttactaccctgattccaagtctgggcgtagtgcgaatggattacgaacagagctttgtgattgccgatattccaggtttgattgaaggtgcttcagatggtgcagggcttggtattcgcttcctgaaacatcttgagcgttgccgggtattattgcacttggtggatttggcgcctattgatgaatcagaccccgctgaaaatgccaaagtaattgttaatgagttgcagcagtacagcgagaaccttgctgagaagcctcgctggcttgttttcaataagattgacctgatagacccagaagaagctgaaaaacgtgctaaggccattgtagaaacgctaggatgggaaggtaagtactacatgatctctgccgcgaatcgcgacaatgtgaatgcattgtgctgggatgtcatgagtttccttaattctcaacctaaagccatggctattgcagaaagcgtgccagagaaagttgagttcatgtgggacgattaccaccgtgagcaactggcggaagttgaagcggaagctgaagacgactgggatgatgattgggatgaagaagatgatgacggcgtagaaattatctacgaacgttaaattctccagttattctttgaataagggctgccattttttcgtggtggcccttattttttggcagggtggcccttattgggggcggtgagcatatctatttctggctgtaagtggtcgcgggtagccagcattgtgccttcagaccagtgcgatcaaggcggttttccaacgtgagtttaccttgatgtaactgggcaatgcggatcacgatattcaatcctaagccactgccaccatagcgttggtccatgcgcctaaatgcttgggttagttcaccagcctgattttgttttatccctgggccttcatcggtgacttgcagtaatacaccctgattttcagtggaaagagtgacgattatttggctaccaaccgggctatagcggtgggcattttcaaccaaattacgcagcatcaagcgtagtagcgtggcgtcaccttccattcttgcatgaggcggtaattcccactgtattgtttgccgacgcaactcacacatttcagccagctcttcctgcaagggggggacgacatcgttaacccaatctagggtttgataatggccactagcaaaattttgtcccgccctcgatagcattaataactgttcaatcgtatgcattagcagatcgatgcgattaatcagcgatttactctcggcaattccctgcttttccattaattccaggtggaggcgtattcctgcgagtggtgtacgcagttcatgggcggcatcggcggtaaacaaccgttcttgctgaatggtattggaaagtcgcaataacaattgattgagtgttgaggtaacagagacaatttcttgcatttcactgttaacaaccaagggggaaaggttatctgcggagcgttctgccaacttttgttgtaattgatcaagtggacgaataatccaactgattgcccagaaagacagcagcagagtgattgtcatcatgattagcgacggtgcaagcagggaggcaatcgcctcagctatttctttatcaacctgctcattacgggcttttgcgctaagagtttcatcgaccagaaaacttatttgttcctgactttcatgccatagccagaatgcgctgatcaactgggtcaccagtaaaatcagcgccagcattaacagcaaacgacggcgcatgctgatcatgataaggcttctaatcgataaccaatacctcgaacggttcggatacgatctttacccagtttgcgtcgcaaattatgaatatgaacttccagcgtattagagctaaggtcgtcattccaggtatatagatcctgttgtaacaactcgcggttaactgtttgcccagctcgcatgattagacgtgagaggatcgcaaactctttaggggttatctctaatggctgcccttgtaaacagacttgttgtgtcgacaagttaaggctcaggtcatcttgctgtaccaggttgtcactctgcccctgataacggcggatgagagcacgtacccgggccagtaattcagccaaggcaaaaggtttgacaagataatcgtcagcaccggcatccagcccgtcaaccctgtcttcaagcgcatcacgtgcggtgaggatgagtactggcagggtgacatgttggcgacgccattgacgtaataacagcgtaccatcctgatccggcaggccgagatcaagaataatcatgctgtactgactggtttgcagcaaactgtgagcttcggcggcggtagctgcgcagtcgcagacatagccttcactggtcagcgccatggctataccgcgttgtagcagttcatcatcttcaacaatcagtaatttcatggctctcagttattctgataaatatctttatagaggcggctctcaaatcgaaccaagggggctcggcgatttttttggtcttcaggtggaacggcatagccggataaaaattgtacaaatgccatacgttgcccactagcggtagtaatgaaaccggcaagattgtaaaccccttgcagtgcacccgtcttcgctgaaactttaccgttgacccccgcttcatgcaggccaccacgataacgtagagtaccgtcatatcctgctagaggcagcattgatataaaattaagctcttgatcattttgagcaatatattgcaaaacctgcatcattgttgctggtgaaataagattatggcgcgataggccagatccatccaccacaatgctgttaccaagatcaacgcctgctttttggcgtaaaatttggcgaacggcatcggcacccgagcgccaagtacccggaaccccaaaacgctgatgaccaatggttctgaagacggtgtcagcgatcatattgtctgattttttcagcatgattttcagcaaatcatgtaagggggctgattgggtctgtgctagcacgtttcccgctggactcggtattgtttggcggcgcagattgccatcaatttgaatatcagcttttttcaattcatcttttaagatagccccggcgtagctggccccattttgcacagcaaaggccaatggcaaaggttcgctgcgctgtgtcagacaaccggtaagcgtaaaccggtttaattcgcctggcacgacgtccaactcacaatattgtgcatcgggtgagcctttggctaacgtgcggacttcactgaacatttgcaccggataataagacgcgacacggataaatgcggtatcgccgggattgggcgcactgtaaagagagactgaaaaacagttgcgatcaacaatggcagcagcaggcggcgcactaaagcattgcgtcatatcgttccatggccaacccggtgctttgtcatgactggcgaatactgaggtatcaatcaccacatcccccgcgatctgtttaacccccgcttttctgagagtcgcaaccatattacgcagttgttgacgcgttaacgttgggtcaccaccaaaccgggcaattaaattacctcgcaacacaccatcagtaatcgtgccatggctttccaaggtagtattgaagcgaaagtctgggccgagttgcaataacgctgccaaggccgtcagtactttttgcgtactggccggtagcgccatctgctgagcgtgatagtctattgcaggggttgatgccccaattttttggaccattaacgcaagatttgccccatcaggcagatactgagtgtaattctcgacctgagccgcattggcattagatacactgatattgagtatgatagaacaggccaatccactgacaattcgtgaaaaatgcataatttcggtataactgctgaataatgtgttgtcatactacggtgcaacgagggagaaagtaaacgatgaccctaaaggaactctacgttaaaatgcatatcaaaatgcaaaattgatcctgacttggggtttttggccctagggttttttttgtttatcgcttggaagcggatagggtatcaagctaaccgtatattcactcgaaaacgttaggatgacggttttttgaacaggatagatttagaggtatttaaaagatgaaacagattccgatgacggtacgtggcgcagataagctgcgtgaagagctggattatttaaaaggtgttcgtcgccctaaaattatttctgatatcgctgatgcacgtgaacatggcgacttgaaagaaaatgcggaatatcacgcagcccgtgagcaacaagggttctgtgaaggccgaattcaggaaatagaagccaagctttcaaatgctcaggtaattgatatcactaaaatgcccaacaatggccgtgttatttttggtgccactgttcgtgtattaaatctgaacactgaagaagaacagaactaccgtattgtgggtgatgacgaggctgattttaaacaaaatcttatttcggttaattcgcctattgctcgtggcctgattggtaaagaagttgatgacgtcgttgttatccatacgccaggcggcgaagtagaatatgaaattcttagcgttgaatatgtgtaatactggcctgtattgaacagtaaatgcccattaagttataaaataaagttgtaaagaaaagtaaaaggccgcaagcggccttttatcagaacaaagtgcatggcacctttctctaaaacaagcgtcattaacgcggtaaaataattttgcgttctttcgccgggcgatagagtactaaaatattaccgatcatttggacgttaacggcaccggtctcacgcacaatagcgtcagcaattagggctttggtttcacgctcttcagcagtgattttcaccttaataagttcatgatgtgctagcgtttgttcgatttcagccagcaccccttcggttaagccgttattgcccagcatgactactggttttaacggatgggccaagcttttcaggtgctgtttttgtttgttattcagattcatcgtcttttttgcttaagttgggattgaaaacggttcattctaccgccatctcatgtgtatcaccaaatcggtctacgccggtaaggagtttacgcgagctaagcaacagatgcgcgggctcttaattaagatagttggaaaaagagatgtctaataaaaagcgttcggctagctccagtcgctggttacaagaacactttagcgataaatatgtaattcaggcacagaaaaaggggctacgctctcgtgcctggtttaaacttgatgaaatacaacagagcgataaactttttaaacagggtatgacagttgttgacctaggtgcagcccctggtggttggtcccaatatgctgtaacccagattggcagtaaagggcgagttatcgcatgtgatcttctaccaatggatcctatcgttggtgtcgatttccttcagggcgattttcgtgatgaactggtcctgaaagctttacttgagcgcgttggggataaaaaagttcaggtggtcatgtgtgatatggccccgaatatgagtggtactccggcagtcgatatacctaaatcaatgtatctggttgaattagctttagatatgtgtcgtgatgtacttgcaccaggtggaagtttcctggtgaaggtgttccagggagatggctttgatgaatacctacgggaaattcgctccctgtttacgaaagttaagattcgtaagccagacgcttctcgtgcgcgatcgcgtgaagtgtacattgtagcgacagggcggaaactgtagtaccctaacgctgtttgttaacacagttgtaatatgaggttaatcccttgagtgacatggcgaaaaacctaattctctggttagttattgcagtcgtcttgatgtctgtattccagagctttggtcccagcgaatcgaatggccgtagagtggattactctactttcatgtccgacgtaacccaagatcaagtgcgtgaagcacgtatcaacggacgtgaaattaacgttagtaagaaagataacagcaaatatacgacttttattccggtcaatgatccaaagctgctagataccttattgactaaaaatgtgaaagttgttggtgagcctccagaagagcaaagcttactggcatctatctttatatcttggttcccaatgttgttattgattggggtctggatcttctttatgcgtcaaatgcagggcggcggtggcaaaggagcaatgtcctttggtaaaagcaaagctcgaatgctgacggaagatcagataaaaacctcgtttgctgatgttgctggttgtgacgaagcaaaagaagaggtcagtgaattagttgactacctgcgtgagccaagccgtttccagaaattgggcggtaaaattcctaaaggcgtgttgatggtaggccctccggggacgggtaaaaccttgctggcgaaagccattgcaggtgaagctaaagtgccattcttcacaatttctggttctgacttcgtagaaatgttcgttggtgtcggtgcatcccgtgtccgtgacatgtttgaacaggctaaaaaagctgcgccttgtatcatcttcattgatgaaatcgatgcggttggccgtcaacgtggcgctggtctgggtgggggtcatgacgaacgtgaacagacgctgaaccaaatgctggttgaaatggatggcttcgaaggtaatgaaggcatcattgttattgcggcaactaaccgcccagacgttctggatcctgcgttattgcgcccaggccgttttgaccgtcaggttgtcgttggtttacctgatgttcgtggtcgtgaacaaattctgaaagttcacatgcgccgtgtgccattagataccgatattgatgcttcagtgatcgctcgtggtactccaggcttctctggtgctgatttggcgaacctggtaaacgaagctgcattgtttgccgcccgcggtaacaaacgcgttgtttctatggttgagttcgaaaaagcgaaagacaaaattatgatgggtgcggaacgtcgctccatggtaatgacagaagctcagaaagaatctacggcctaccatgaagcagggcatgccattattggtcgtttagtgccagagcatgatccagtgcataaagtgacgatcattcctcgtggccgtgctctgggtgtcaccttcttcttgccggaaggcgatgcaatcagtgctagccgccagaagttggaaagtcagatttctaccttgtacggtggtcgtcttgcagaagagatcatttatggcccggaaaaagtgtctaccggtgcttcgaatgatatcaaagtggcaacgtctattgcgcgtaacatggtaacgcagtggggcttctccgaaaaactggggccgttgctgtatgctgaagaagagggcgaaattttcctcggccgttctgtagcgaaagctaagcatatgtctgatgagactgcgcgtatcatcgatcaggaagttaaattacttgttgagcgtaactatcagcgtgcacgtaaattgttgttagaaaatatggatgttttacactccatgaaagacgcgttgatgaagtatgaaactattgatgcgccacagattgatgacttgatgaatcgcaaagaagttcgcccgccagcgggttgggacaatgtgaccaaaaataaatcatctgacaatgacaatacaccaacggcaaccatgccggctgatgaaccgaatactccaacgtcgggcaatacagtgtcagaacagttgggtgataagtaaatcaactagctgttggcatctaaaagcgttgtgactaatataaccctaggcttgcctagggtttttttgttgctaaatttaataactgaagtgaatagccacttttaaggcgcaataacatgcatctaactgccagaggtctgacgttggatctctctcgtccacaagtcatgggtattctgaatgtcacaccagattcattttcagatggtgggcgtcacaataaccttgatcaagcattgcaacatgctcaacggatgttatcggcaggcgctacgctgattgatatcggtggtgaatcaacgcgccctggggctgctgaagtcagtgagcaagaagaacttgatcgagtcgtgcctgtggttgaggcgttagctcagcgttttgatgtgtggctctcggtagacacgtctaaagccgctgttatcactgaatctgctcatgcaggtgcccatctaattaatgatatccgctcgttgcaagagcctggcgctcttgaagcagcggcaaagactggcttaccggtgtgcctaatgcatatgcaggggcaaccgaaaaatatgcagcattcaccctactatgatgatttaatgaccgatataaatcggttcttccaacatcatattgaacgctgtgttgcggcaggtatcgcaaaaaataaattgttgctcgacccaggcttcggtttcggtaaaaatctggcgcataattaccaactattggcacatctgtcagagcttcaccattttgagttgccattattggtcggaatgtcgagaaaatcgatggtaggccaattattgaatgtaccaccacaacagcgtgtcatcgggagtgttgcttgtgcggtgattgctgccatgcaaggtgcgcagattatcagagtgcatgatgtcaaagaaactgtcgaggcgatgtgtatcgtcgaggcaacacgttcagcgaagggataaagataaattatgagtaaccgtaaatactttggtacagatggcattcgcggtaaagtgggtgaaagtccgattactccggattttgtattgaagcttggctgggctgccggtaaggttctggcacgacatggttctcgtaaaattattatcggtaaagacactcgcatatctggttatatgctggaatcagcacttgaggcgggcctggcagccgctgggctatctgcgctatttactgggccgatgcccacacccgctgttgcttatttgacacgtaccttccgcgctgaagcgggtattgtaatttctgcttctcataaccctttctatgataacggtattaagtttttctccattgatggcaccaaattgcctgatgatgtggaagaggctattgaagccgaaatggaaaaaccgctgacttgtgttgaatccgctgagttgggaaaagctaaccgtattgttgatgctgctggtcgttacattgagttctgcaaagggacattcccaagcgaacttagcctgaatgagctgaaaatagtggtcgattgtgccaatggtgctacgtatcacatcgcaccaagcgtattacgtgaattgggcgcgacagtgattaccatcggctgtgaacctgatggtatgaacatcaacgaagagtgtggtgctacagacgttcgtttgctgcaagaacgtgttcttgccgaaggggctcacgtaggcttggcattcgatggggatggcgatcggctgatgatggttgaccatttggggaataaagttgatggtgaccaaattctgtacattattgcgcgtgaaggcttacgccaaggtcaattgaaaggcggtgcggttggcacgctaatgagtaacatgggccttcaattagccctgaaagatctgggtatcccatttgttcgtgccaaagtgggcgatcgctatgtcttggaagcgatgcaagagaaaggctggcgtattggtgcagaaaactcgggtcatgtaattttattggataaaaccaccactggcgatgggattgtggcaggtttgcaagtgctcaccgccatggttcgtaaccatatgagtttgcatgacctgtgtagtggcatgaagttattaccacaaattttggtaaatgtgcgtttctccggcgagcataatccactgaaatctgatgaagttgaagaagtgacccggcaggtggaaaaagaattgggtggccgtggccgggttctattacgtaaatcgggtactgaaccactcattcgcgtcatggttgaaggtgatgcggaagaatcactgatagctgaaatggcaaaccggattgctgatgcagtaaaggcagcaggttaacccttttttaaagggggagaggcactcttccccaagaaattacgctgaagttgaataacttgacgcttttttctgcaaataaacccatgtgatgaaattgcccttgcgtgaactagacgctttggttagtattcacacccgcttaagtgggtgaataagtcccccgctgatgggtgagaagcatttggcatgcggtgaacccgcaaggatacaggtacaactatgtacgaagctcttctggtatttttcttgctgatttcgattgggctcgtagctcttatcatgttacagcaaggtaaaggtgcggatatgggagcctcattcggagcaggtgcgtctgcaactctgttcggttcgaatggttccggtaactttatgacccgcatgacggctgtattggcgacgctgtttttcgtcattagcttgattttgggaaacatgagctccaaccagggccaaaaaagcagtgagtgggaaaatttaggtcagccactgaaaactgagcagactgcaacgccggtagcaccagtgaaaccgagcagtgatatcccgcaataataatgtttctcagcagcacagtaagtgtaaagaaaaagagttttaaaagggttgttgttacttggacagtaaaaacaaccagttgaatcagtgccggggtggtggaattggtagacacgctaccttgaggtggtagtgcccgattgggcttacgggttcaagtcccgtcctcggtaccaaatcagatagataacttgcttttttatcgttatcgacgtagtatttgccacgttttcggacgcggggtggagcagcctggtagctcgtcgggctcataacccgaaggtcgtcggttcaaatccggcccccgcaaccactttcctaaagtgttttttttcaaatgttgtattcggtagacctcagatactttcgatttcaatttgaaaaaaatacttgccagagagttgcaccgaagccgctttgcggcaaacagggtccagttgcataaagccccgaatttcggggttttttgttatttgacagcagaatcactgggctattaagccctttttttatgtcttgggggtgggcttgtccacattagaacaaaagttaacagagataatttcagcaccggttgaagctttaggctacgaattagttggcatcgaattcatccgggggcgccaatcgacgctacgaatttatattgatagtgacgacgggatcactgttgatgcttgtgctgatgtcagccaccaggtcagcgcagtattggacgtagaagatccgattacggtcgcttacaacttagaagtttcctctcctggccttgatcgcccaatgttcacggctgaacattatactcgttacctcggcgaagaggtcactttggttttgcggatggcaatgcagaatcgccgtaaatggcagggtattattaaagccgttgatggcgaaatgatcacggttactgtggatggaaaagatgaagtgttcgcgctgagcaacatccagaaagcgaacctggtaccccacttttaaagtttggatgaggcaactaggatgaacaaagagattctggctgttgtagaagcagtttccaatgagaaatcccttccgcgcgagaagatttttgaggcgttggaaaccgctctagcgacagcaaccaagaaaaaatacgaacaagagattgaagtccgcgtcagtattgaccgtaaaaccggtgattttgatactttccgccgttgggtcgctgttgacgaagtgactatgccaacccgtgaaatcacgttggatgcggctcaatttgaagatccttctctccaattgggtgattatgtcgaagaccagattgaatcggtgacttttgaccgcattaccacccaaacagccaagcaagtcatcgtacaaaaagtacgtgaagctgaacgggcgatggttgttgagcagttccgtcaatatctggggcaaattgtcactggtattgttaagaaagttagccgtgacagtattgcactggatctgggccacaatgcggaagctgttattggtcgtgaagatatgctcccgcgtgaaaatttccgcccaggtgaccgtatccgtggtgttctgtatgacgtgcgtccagaagctcgtggcgcacagttgtttgtcagccgttcacgttctgaaatgttggtcgaactgttccgcattgaagtaccagaaattggtgaagagctgatcgaaattaaagccgctgcccgtgatcctggctctcgtgctaaaattgcggtcaaaaccaatgacaagcgtatcgatccggttggtgcttgcgttggtatgcgtggtgcccgtgttcaggctgtgtccagcgagcttggcggcgagcgcattgatattgtattgtgggatgataatccagcccagtttgttattaacgctatggcgccagctgatgttgcgtctattgtggttgatgaagacaaacacacgatggatgttgccgttgaagccagtaatttggcccaggcaattggtcgtaatggccagaacgtacgtttagccgcgcagcttagtggctgggaactgaacgtaatgacggcggacgatcttcaggcgaagcatcaggccgaggctcatgccgctattgataccttcactaaatatcttgatatcgatgaagactttgccaccgtattggtagaagaaggtttctcttctctggaagagttggcttatgtgccaatgaaagaacttctggaaatcgatggtcttgacgaagatacggttgaagcgctgcgtgatcgcgccaaagctgcattgaccacgctggccctggcacaagaagaaagttttggcgaccagaaacccgctgatgacctgttgaatttagcgggtctggaacgtagcatggcattcaaattggctgcgcgcggtgtatgtacgctggaagatcttgccgagcagggtatcgacgatttggcagatattgaagggcttagcgatgagcaagccggtgagctgattatggccgcacgtaatatctgttggtttggcgataatgcgtaataaactgtagcaggaaggaacagcatgacagatgtaaccgtaaaatcgctggcagcagagattcagaccccggttgatcgcctggtacagcagtttgctgatgcagggatcaagaagtctgacgtagactcagttacccagcaagaaaaagaaatactgctggcacacttaaaccgtgaacatggtagtgtgcctaacaaactcacgttgcaacgcaaaacgcgtagcaccttgaatattccgagcaccggcgggaaaagtaaatcggtgcaaatagaggtccgcaagaaacgcacttatgtaaatacgccggaagctgaacaagcgaaagcggaagaacaggcacagcgtgaagcggaagagcaggcacaacgtgaagcggaagccacagcgcagaaaatcgctgaagaaaaagctaagcgtgaggctgaagaacaagccaaacgtgaggccgctgaaaaagctaagcggcaagcagcggaaaaagaaaaagtgacgaatcaacaaaccgacgaaaaaactaagccagctcagaccgataaagcacgtcgtgaagctgaagctgcagagctaaaacgctctgtagaagaagaaacacgccgtaaggtcgaagaagacgccaaacgcgttgctgaggaagcccgtaaaatggcagccgaaaatgaaggcaaatggcctgagccagtggctgagcagactgagtctgctgactatcatgtcaccacctcacaacatgcacgcgccgcggaagatgaaaacgacgccaaagttgaaggtgatcgccgcagccgtactcgtggtggtaaagcgactaaacagaagaaaggcaacaaactctctgagtctaaagctgatcgcgaagaagcacgtgctgttggccgcaaaggcaaacgtaaaccaagcacattacagcagagctttaacaagcctgttgttgcggtgaaccgcgatgtagtgattggcgagacagtaacggttgctgaattagccaacaaaatggcggttaaaggctctcaggtcatcaaagccatgatgaaactgggtgcaatggcaaccattaaccaggttatcgatcaggaaacagcacagctggttgctgaagagatgggccacaaagttatcctgcgtcgtgagaacgagctggaagaagcgctgatgagtgaccgtgatattggtgttgaagctgccgctgagcaccgcgctccggttgtgaccatcatgggccacgttgaccacggtaaaacgtctttactggattacatccgctccacgaaagtggcgtcaggtgaggccggtggtattactcagcatatcggtgcttatcacgttgaaactgaaaacggcatgatcaccttcctggacaccccaggacacgccgcgtttacatcaatgcgtgctcgtggtgctcaggcgacggatatcgtagtactggttgttgcagcggacgatggcgtgatgccacaaactatcgaagctattcagcatgctaaagcggcgaacgtgccggttgtggttgcggtgaataaaatcgataaaccagaagctgatccagatcgcgttaaaactgaattgtctcagtacggtatccagcctgaagagtggggcggtgagtctcagttcatcaacgtatcagcgaaagccggtatcggtattgatgaattgttgaacgctatccttctgcaagctgaagttctggagctgaaagccgtacgtactggtatggcaaacggtgtggttatcgaatccttcctggacaaaggccgtggccctgtggcaaccgtgctggtccaacaaggtaccttgaacaagggcgatatcgtactgtgtggctttgaatatggccgtgtccgtgcgatgcgtgatgagctaggccgcgatattacttctgcgggtccgtctattccggttgagattctgggcttgtccagtgtccctgctgccggtgacgaagtgactgttgttcgtgacgagaaaaaagcccgtgaagttgcactgtatcgtcagggcaaattccgtgaagttaagttggctcgtcagcagaaatctaagctggaaaacatgtttgctaacatgaccgaaggtgaagtttctgaactgaacattgtgatcaagtctgacgtacagggttcttgtgaagctatctgcgactcactggaaaaactgtctaccgatgaagtgaaagtccggattgttggctcaggtgttggtggtatcaccgaaactgatgcaacactggccgctgcatctggcgcaatcattcttggttttaacgttcgtgctgatgcttccgcgcgtcgtgtagtggaaactgaaggcttggatctgcgttactactcagtaatttatagccttatcgacgaagtgaaacaggcgatgagtggtatgctggcacctgagtacaaacagcaaatcattggtctggctgaagttcgtgacgtctttaaatcaccgaaatttggtgccattgcaggttgtatggttaccgaaggtgtgattaagcgtaacaatccaatccgtgttctgcgtgacaacgtggttatctatgaaggcgagctggaatccctacgccgcttcaaagatgacgttagcgaagttcgcaacggcatggagtgtggtatcggcgttaagaactacaatgatgtgcgtaccggtgatgtgatcgaagtcttcgaaattatcgaaatcaaacgtaccattgcttaagcacttctgatttgcaaatatccatttggggggccttggccccccaaactgtctggagaatccaaatggcaaaagaatttagtcgttctcagcgtgtttctcaggaaatgcaaaaagagatcgcactcatcttacagcgtgaaatcaaagatcctcgtgttggtatggctacagtgtctggcatcgaactgtcccgtgatttagcctacgctaaagtatttgtgaccttcttgaatgtgttaactgataacgcagatccggatacggttaaaaacggcattaaagctttgcaagatgcttcaggttatatccgcactttgctgggtaaagccatgcgtctgcgtatcgtgccagagctgacctttgcctatgataactccctgattgaagggatgcggatgtctaacctggtgagcaatgtcatcaaaaatgatgtagagcgtcaggttaatccaggtagtgacgaggagaagtaatggggcgtccacgtcgtcgcggccgtgacattaacggcgttttgctattggataagccgctaggcctctcttctaatgacgttttgcaaaaagtaaaacgtctctttagcgctaatcgcgctggtcacacgggtgctcttgatccattagcaaccggtatgttgcctatttgtctgggcgaagcgactaagttttctcaattcttactcgattcagataaacgttaccgagtggttgctcggctggggcaacgcacggatacctcagatgcggaaggtgcgttaatcagtgagcgtgaggtcaatcttactcaagctcagatcgatactgcactggagagtttccgcggtgaaagccagcagatcccctccatgtattctgcattgaaacatcaaggtaagcctctttacgaatatgcccgtcaggggattgaagtcgaacgtgaagctcgcagcattacggtttacgagttgctcttcatccgttgggaaggcaatgatctggaactggaaattcactgttcgaaaggaacgtacattcgtaccatcatcgatgacttgggtgaattattgggttgcggcgcacatgtcagttatctgcgtcgcttgcaggttgcgacttacccgagcgaacggatggtgaccctagagcagttaacggcgatggttgaggctgcgcaggcagagggacgctcgccaaatccagaactggattcgctgttattgccgatggacagtgccgttcttaattttcctgaagtcaatctgttaccttccgtggccgcttatgtaaaacaggggcaaccggtgcatgtgtcaggtgctcccagtgaaggaatggtccgaatcactgaaggtaaagagcgtaatttcattggtattggtactatcgcagaagatggccgcgttgcccctaaacgtttggttgtggaaagcgtggaagtagaaaatctgccagtagaaaataaaaagtaggccacacggcctgccttgcgatcccgcgattcaaagagtagaatagtgcggcttacatattgggttgctgaattagagatcggcgcctgtcttaattcatttatatatttggagttgtatcatgtctctaagtgttgaagcgaaagctaaaattgttgctgacttcggtcgcggtactaatgacaccggttcaagcgaagttcaggttgctctgttgactgctcaaattaaccatttgcaaggtcacttctccgagcacaaaaaagatcaccatagccgtcgtggtctgttgcgtatggtatccacgcgtcgtaagctgctggactacctgaagcgtcaagatgtagcgcgttacgcttccctgatcgaacgtttaggtctgcgtcgctaagtctgcgagtttcgggagaaaggggccaagttggccccttttttctaagaagtaatgatagaatacgttagtatattgttattattatataagatttataaataggatcttccaatgcagaggttcgcgcggctaatgagagactttaacttaatgaaagttaaggattgtcattagtcgcgaggatgcagtgtgaaggtatcagtaacaggtggattagatcgtcaatacgatcaggcaccgcaaagcataagggtacaattttgctgactccgattattcgtaaattccagtatggtcaacataccgtaactatcgaaactggtatgatggctcgccaggccactgcagccgtaatggtaagcatggacgacactgcagtattcgtgactgttgttggtcaaaagaaagccaaaccaggccagagtttcttccctctgacggttaactatcaggagcgtacttacgctgctggccgtatcccaggtagcttcttccgtcgtgaaggccgcccaagtgaaggcgaaacactgacttcacgtctgatcgaccgcccaattcgcccactgttcccagacagcttcctgaacgaagttcaagtgattgcaaccgtcgtttcggttaacccacaaattaacccagacatcgtggcactgattggtgcatctgcggcactgagcttgtcaggcattccatttaacggcccaatcggtgctgctcgcgttggttttatcaacgaccagtatgtgctgaacccaaccactgacgagctgaaagagagccgtttggatctggttgttgccggtactgcgggtgcagtgctgatggttgaatcagaagccgatattctgtccgaagagcaaatgttgggcgcggtcgtcttcggccacgaacaacagcaagttgtgattgaaaatattaacgctttggttgctgaagctggtaaacctaagtgggattggcaggcagagcctgtcaacgaagcactgcatgcgcgtgttgctgaactggccgaagcgcgtctgggcgatgcataccgtatcactgaaaaacaagaacgttatacgcaagttgatgctatcaaagctgacgtgaccgaagcgctattagcgcaggacgacacattagatgccgctgaaattcaggatatcctggccagcgttgagaaaaatgttgtgcgtagccgtgtgctgcgtggtgagccacgtattgatggtcgcgaaaaagacatgatccgtggtttggatgtacgtactggcatcttgccacgtactcatggttctgccttgttcacccgcggtgaaactcaggcgttggttaccgctacgctgggtacggcacgtgacgcacaaaacattgatgagttgatgggtgagcgcacagattcattcctgttacactataatttccctccgtattgtgtaggcgaaacagggatggttggctcacctaagcgtcgtgagattggccatggccgccttgcgaaacgtggtgttctggctgtgatgccaagtgcgagcgagttcccttacactattcgtgtggtttctgaaatcaccgagtctaatggttcttcctcaatggcttctgtttgtggtgcttctctggctctgatggatgcgggcgtgccaattaaagccgctgttgctggtattgcaatgggcctggtaaaagagggtgataactttgtcgttctgtctgacattctgggtgacgaagatcacttgggcgacatggactttaaagtagccggtagccgtgacggtgtgaccgcactgcaaatggacattaaaattgaaggtattacccgcgaaattatgcaggtagctctgaatcaggctaagggtgcacgtttgcacattctgggcgtgatggaacaggctatcagcacaccacgtggcgatatctctgagtttgctccacgtatctacaccatgaagatcaaccctgagaaaatcaaggatgtgatcggtaaaggtggttcggtgatccgtgcgctgactgatgaaactggcaccacgattgaaatcgaagatgatggtaccattaagattgcagcaactgatggcgataaagcaaaacacgctatccgtcgtatcgaagagattactgctgaaatcgaagtgggccgtatttacgcaggtaaagtcacccgtatcgttgatttcggtgcatttgttgctatcggtggcggtaaagaaggtctggtacatatttctcaaatcgctgataagcgtgtagagaaagtgacagactacctgcagatgggtcaagatgtgccagttaaagtaatggaagttgatcgtcagggccgtatccgcctgagcatcaaagaagccactactcctgacgcagaagcaccagaagcagcagagtaattaagtcattccacagctccttgctcatcggtaaggggctgtgttatctcaggggcgggatgctcttgtgttaaacaaatggatgaaaggatgtttatccaatgtttgtcttcgggagtaggaaatgaagcctttcttgcgctggtgttacgttgcgacagcactcatgctggcaggatgcagcaaccatgattggcgtaaagacgaggttttggcaatcccgttgcaaccaacgttacagcaggaagtgattctggcacgcatggaacaaatccttgcaagtcgggcacttacggatgatgagcgcgcgcagcttttatatgagcgcggagtgctgtatgatagcctcgggctacgggcactagcgcgaaatgatttttcgcaagcgttagctattcgtcctgatatgccagaggtttttaactatcttggcatatatttaacgcaggcaggcaattttgatgctgcctatgaagcgtttgattctgtactagagcttgatccaacttacaattacgcgcgtttaaaccggggtatcgccttgtattatggcggtcgattcccgttggcgcaggatgatctgcaggcgttttatcaagacgatccaaatgatcccttccgttcattatggctgtatctggtggaaagagaaatcgatcctaaagcagctgtagtagcgttacaacaacgctatgaaaaatcggacagagggcaatggggatggaatattgtcgaattctacctgggcaagatcagcgaaaaatcgctgatggaaaggctcaaggcagatgcaacggataacacttcgctcgctgagcatctcagtgaaactgacttctatttaggtaaacattacctaagtctgggggacaagaacaccgcttcggtgctgttcaaactgacggtagctaacaacgttcataactttgttgagcaccgctatgcattgttggaattggcacttttgggccaagaacaagacgacctatcggaatcggaccagcaatagctgacgaacaactatcagcctgatataccttggtttttaccaaagttaatcaccctaacaggtgatggcctttttgttcgttttataatctaatttgagccggttcacacttttcaatgaaaatgactgaaaattttctcgacgagttatgtagactggctgccattattaatgaggcacgtgtacatgactactgagcttgaaacctcttttgctgatctggggctgtccgctccaattctttccgctctgactgatcttggttatgaaaaaccatctcctatccagttggaatgtattccacacctgttaaacggccgtgatgttctcggtatggcgcaaacaggcagtggcaaaacagccgcgtttggtctgccgctgttacacaatattaaagctgatctgaagtcgccacaggttctggtgttggcaccaacccgtgaattggctgttcaggttgctgaagcgctgtccagtttctctaaacacattaatggcgtcaacgtggtggccctgtacggcggtcagcgttatgacgttcaattacgcgctttgcgccaggggccacaagttgttgttggtaccccaggtcgtctgttagaccacctgaaacgcggtacccttaacctgtccaacctgagcggtttagtgttggatgaagcagatgaaatgctgcgcatgggctttatcgaagacgttgaaacgattatggcgcagatcccggctgaacatcagaccgcgttgttctctgcaaccatgccagaagcgattcgtcgtattacgcgtcgcttcatgaaagaaccacaggaagtccgcattcaatctagcgtgacgacccgccctgacattagccagagctactggagagtgggtggcggttaccgtaaaaatgaagcgctggtacgtttcctggaagctgaagatttcgatgctgctattattttcgtacgtaccaaaaatgcgaccttggaagtagcagaagcccttgagcgtagcggctacaacagcgcggcactgaatggtgatatgaatcaggcactgcgtgagcagacgctggagcgtttgaaagatggccgtctggatattctgattgcaactgacgtagctgcccgtggcttggacgttgagcgtatcagcttggtcgtaaactatgatatccctatggattcagagtcttatgttcaccgtatcggtcgtactggccgtgcaggtcgtgcaggtcgcgcgttgctgttcgttgagaaccgtgaacgtcgtctgttgcagaacatcgaacgcacgatgaagctgacgatcccagaagttgagttgccaaacgcagatttgctgagcgaacgtcgtttagctaaattcgccgctaaggttagccaacaactggaaagcagtgatttggatatgtaccgcgcattgctggctaagctgcaaccggaagaagagtttgatatcgagactctggctgctgcactgctgaaaatggcgcagggcgaacgtcctctgatcctgccaccagaagccccacgccgtccgcagcgtgaattcaattcacgtgatgaccgtggtaacgatcgtggtagccgtgatcgtggtgacagccgtcgcgataaccgctctgacagccgttctgctgatagccgtgatggtggtgagcgtcctgctcgtcgtgaacgtcgtgatgttggcgagatggagctgtaccgcattgaagtgggccgtgatgatggtgttgaagttcgccatattgttggcgctatcgctaacgaaggtgatatcagcagccgttatatcggtaatatcaagttgtttgcttcccactcaacgattgaactgccaaaaggcatgccgggcgaaatgttatctcacttcacccgtacccgtatcctgaacaagccgctgaacatgcagctgttgggtgatgcacagccacatgaacgccgtgagcgtccagcgggtggtaacggtggtgagcgtcgtggcggtggccgtccattcagtggcgaacgtcgtgaaggcgcaggcgctcctcctcgtcgttcatttagcggcgatcgtgctcctaccggtggtggtgagcgtcgtggtaaccgcgatggtcagcgttctgcggccccacgtcgtgatgatgctgccgcacctgctgctgcagccgccgcaccagcccgtcgtcgcttcggtgatgcataagttcgcttagtcatctctgatgattaaacgtaaaaaccagccttcgggctggtttttttatggctattatttatcgttatatcatgattatctcctgcttattttttatgctcacctgctcattaagccaaacttatttggccttacagccatgccaattgctttggatagagagatgtatttgttaacttaagccaccgatggtgctattaaagtaaacctataagttgacagtatgggcagggatgaccaaaatcataaacgtcgaaaaaattttcctatcaggctactgggctcggcaagaaaggaacttagcgatttagatgcaatcaatagagccgaatttttggttgctattgatgtctttgaactccatgggcctggttctggtgtgcctaacgtggagaagatcgggggcgatatgtatgagcttaaaacacacagtagaagtcattggctccgaggtttttattttcactacgttgatggcctttatattgttacgcatatttttgccaagaaaaccaataaggcacctgattccagcaaagcactcggattacgtaggtataaagatttcctccgttctcagggtgaggaataaattagcaacaaaaagaggttgttatgaaaagtgatctgacactgcacgcttgggatgaggttcgggcagaactcttacaagatgaagaaaccgcaagggcctatgctatcgtcatgctacgtaaggcactactcaatagtctggttgcggtcagaaaatccaaacagttgacgcaggttgatatcgctaaacgcatcggtgtgagtcggcaggcgatcagcaaattcgagaaaggtgagtcagccccgactcttgatactctgattggttatacggcggccatggatattgattttgctgccaatatgaagaaaatatttactcaaacattttgatgattaaacgtaaaaaccagccttcgggctggttcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaacaacctcaaaccagccttcgggctggtttttttatggctgtgatttgtatctgcctacgatattaccggcgcggagtatgcatcagatcttgctgtaagctggcaacggttttaaaggaatacagccgtgcttgatgatcaaaaatttggccattaatcatcaattcgtcagcctgtgtttcccgtaataatgactgaagcccatggcgtactttacttttatcaccgacgatggataagcgcagcgcctgatcgacaccaaactgttccgctggcgagcaaattgccgccatattctccactggcggcggtaactggcccggtgtcccccggcgcaggctgacaaattgttgctgcattgaggtaaacaggaagcgtgcatcgcgctcgctatctgccgcgaccacgtttacgcagacaatggcatagggctttggccattgagcggatggtgtaaagttctcacggtatagcgagagtgcctgtaacaacatatctggggcgaaatgtgaggcaaaggcaaacggcaggcccatcgcggcggccagttgtgcgctatacagactggagcctagcagccacagcggaacatgcagcccctggcctggcactgcttgtactgcttgccccggttgtacttcggcaaagtaattctgcagttcacgcacatcggctgggaagttatccacttcaccagagagatggcgacgtaacgccatcatagtgcgttgatcgctaccgggtgcacggcccaaaccgagatcgatacgatcagggtagagcgacgcgagggtaccgaactgctcagcaatcaccagcggtgaatggttcggcagcatgacaccaccagcgccgacgcggatcttattcgtgccacccgcaatatagccgatcagcaccgacgtcgccgcgctggcgataccggtcatattgtgatgttcagcgagccagtagcgctgatatccccatttttcagcatgttgtgctaaatccagtgaagcatgaaatgcatcccgtgctgttttaccctgtgctatcggggataaatcgagcacagaaagggggacagtatttttatcgactacagaaccggtgttatcaatcatagaatcgtccatcttaaccttatgtcgagtcgcttgaagggcgaacgcattatcttcttgttggtacttgaagttgagagtgggtacttgaaattacagatgagtatttgaaattacaggatcgttagctgcgcgtactcatcaaaatcaattacttatgcaagcttatcgggattacctcgcttgccgccttcctaaaactcaaattattttgggtatagccgcattaattgacccaccaaaaatgacgtaaaacatgaggctattactctggcagcataatctaaataaatgctgccgaagggggaataaatgcggcgattaaaaaacgagtgaacctacgaagacgaaaaggttatttatcctattgtttgtggtggtcattgcgatttttttaatttattgggactgaaatattttttttcggaatccttacgtaatgctgaaaaaatcaaacagtcgatatccgtacaattacgaacaatgactatcaacacaatgaatgtacggtaaaattttatgcacagtaaaattattttggcctgtttggtgttcacgcttgtcgcttgtgatcaatcctcttcaccttcagcgacaccctcgcgacaagaggtgggggtggtgaccttaaaaactcaaccggtcacattgagtagcgatttatcaggccgaacggtggcggcaatgacgtctgaagtcaggccacaggtcgatggtatcatcaagaaacgcttgtttactgaaggatctgaagtcaccgcgggacaagtgctctatcaaatagaccctgctagttatcaggccgcttatgacaccgcaaaagccgcgctacaaaatgttcaggtcagcgtaaaatcggccaagctgaaagcccagcgctatgcggcattagccaaagaaaatggtgtgtcgcagcaagatgctgatgacgcccaaaccagctatcagcaagcgctggccaatgtggccgaaaaaactgctgcgctggaaacggcgcgtatcaatttggcctatacccaagtgcgggcacccatttcaggtcgcatcggcatttcctctgtgacaccaggggcgctggtgacggctaatcaaaccacggcattagccaccatccgtaaccttgatcccatttatgttgatttaacccagtccagtgcgcagttgcttgctttacgcaaacagcagcaggcaggcaatgacacagtagcgaatgcgccggttcagctaacgctggaagatggctcggtttatgcccacgaaggttctctgcaactgaccgaggtggccgtggatgaagcgaccggtgcggtgaccttgcgtgcgaaattccctaaccctgaacaccaattattgccgggcatgtttgttcgcgcttcagtacggaacggtgtaaataacaccgctattttggcaccacagcaaggcatcactcatgatgcgaaagggaatgctaccgcgttggtggttaatcaacagcagcaagttgagcggcgtgaagtggtaaccgaacgcacgattgatagctactggttgattagccgtgggctggctgcaggtgaccgcctgattgttgaaggaaccgaaaaggtcagtgttggcgatgacgtcaaaccggtagaggtgagcactacgctgcccgttgtggccgaaccgactacgccatcaactggggagaaataatcgatgtttgcccgtttctttatttatcgcccggtttttgcctgggtcattgccattgttattatgttgggcggggtggttgcgctggaaaccttgccgatagcccagtatcccgatgtcgcaccaccatctatttccattaaagccacctataccggtgcttcagcagaaacactcgaaaacagtgtgacgcaggtcattgagcaagaactgaccggattggatggtctgctctatttttcctcctccagcggttccgatggtaatgccaagatcgtcgccacatttaagcaggggactaatgctgataccgcgcaggtacaggtgcaaaataaggttcagcaggcgctaacccgtttgccaacagaggtgcaggcgcaaggggtcacggtgaccaagtcgcagactaacttcttgttgatcatgtcgctgtatgatgaaaaagacaaacacaccggaacggatattgccgactatctggtcagcaacctgcaagacccactggctcgcctcgaaggggtagggagtgtgcaggtgtttggttcgcaatatgcgatgcggatttggttaaatccgaccaaactggccgcttacaatctgatgcccagcgatgttcaatccgccattacggcacagaacacacaggtttctgctggcaaaatcggggcgttaccgagcggtaaagagcagcaattgaccgcgacagtcatggcgcaatcccgcctgaaaacaccggagcagttcaacaatattattgttaaaagtgacagcacgggcgcggtggtacgactgcgcgatgtggcccgtgttgagctgggcaatgaagattacagcgtgacgacccgcttgaacggccatccagccgcggggatcgcggtgatgctggcacctggtgctaatgcgctggcgaccgccgagcgggtaaaggccaaggctgccgagtttgaattgaacttgcctgacggatacaaaatcgcgtatccaaaagacagcactgattttattaaagtttcggtcgaggaagtggtgaaaacgctgatcgaagccatcttgctggtggttatcgtgatgtacatcttcctacaaaatatccgtgccactttgataccggctattgccgtcccagttgtgttgttagggacgtttggggtgttggccatattcggctactcaatcaatacactgacactttttggtatggtgctgtcgatcggcttgttggtcgacgatgctattgtcgtggtggaaaacgttgagcgggtgatgcgggaagacaatctcccgccccgtgaagcgactgagaaatctatgagtgagatctccagcgcactgattgggattgcactggtgctctcggcagtattcctgcccatggccttctttggtggggcgaccggcgttatctaccgccagttctccatcaccattgtgtcagcgatggcgctatccgtgttggtcgcattaactctcacgccagcattgtgcgccaccttcctgaaacccaaccataaaccgccatcagagcacggtttcttcggcgggttcaaccgtcgctatgaccggatgcagacccgttatgaaagcctggtagggcatgttattcaccgctctttgcgctatttactgatttacgccgtgctgattggggtgatgtgtgtgttgtttattcgcctgccaacgggctttttacctaccgaagatcagggtgatgtcatggtgcaatataccttgccagcaggggcaaccagtgggcgcaccatggaggtcagtaaggcggtagaaaactatttcatgacacaggaaaaggacaataccaaagcagtcttcactatctccggttttggctttagtggtagtgggcaaaatgccggtatggcgtttattgcattgaaacactggcgtgatcggccgggcagtgaaaataccgccacagccattgcagatcgcgcgatgaaggcactgtcgagtattcgcgatgcccaaattttcagtatgacgccacctgcggtggatgggttaggccagtcgaatggctttacttttgagttgcaagccacaggggataccagccgcgagcaactgctgaccttgcgcgatcaactgattagcaaggcgaataaagaccctattttggcctcagttcgcgccaataccttgcaacaaatgccgcagttacaagtagatatcgataacgataaagtcgcggcattagggctgtcgatcagtgatgtgaatgccacattaagtgccgcctggggtgggacgtatatcaatgactttattgatcgtgggagagtgaaaaaagtgtatatgcagggtgatgtggatacccgctctaaaccggaggatctcaaccaatggttcgtgcgcggtagcagtgatgccatgacatcgttttctgcctttgcgacgactcgctggatttacggcccggaaacgctttcccgctataacgggcagacgtcctatgaaattcaggggcaggccgcttccggcagcagttcgggcaccgcaatggatcaaatggagaaactggcggctgaattacctggcaccagttatgcgtggagcgggctgtcttatcaggagcgtttagccagcgggcaagcattatcgctgtatgccatttcaatcttggtggtattcctgtgcttggcggcgttgtatgagagttggtcagtcccgttctcggtcatgatggttattccgttggggataatcggtgcagtagcggcagcgacgctgcggggattggaaaatgatatttacttccaggtggcgttgttgacgaccctgggtctggcatcgaaaaacgccattctgattgttgaatttgccgaagcggcctatttacgcggcgaaccgctggtggcggcggcgttgcagggcgcggcgactcgcttacggcctatcctgatgacatcgctggcatttattgctggggtgatgcctctggcaatgtctaccggtgccggcgctaacagccgcatttcaatcggcagcggcattattggcggcaccttaacggcgacagtgttggccgtcttttttgtcccgctcttttttgtcttgattcgtcgagtgttcagcggcaagtcaaaaaatatcactgaacataaaggagtataaaatgttcagtcgtatactgatattatcgttacccgcgctgctggccggatgtatttctctcgatccggactatcagcgcccagtggcaccggttccggcaaccttgccttactcaaccgccagtagcagcaaggcggcagatattccgtggcaggagacgatcattgatcctaaactgcgccaggtgattgcgttggcattagagagcaaccgtgacctacgccaagctattgccgatatcgaagcggcccgtgcgcaatatggtgtgcaacgggccgcccagctaccaacggttaatgcaggagtcaatggcagccgtgggcgcggattgtccgatacctctgatggcaacaacaataccgctatcagccagagttatggtgcccaagccagtgttagtgcctttgaactggatttatttggtaaaaaaagcagcttgtctcatgctgaatttgaaacctatctggcaacagaagaagcggcgaaaaccacccgcatcacactgattgctgatactgcgacagcttgggtaacactggcggctgaccagaatcaattattgctggccgaagagacgttaaaaagtgcggagcaatctttaaaattggcacaactgcggcagaaaaatgggatagcgtcacgtattgatgtagcggcgatggaaacgttgtatcaatcagcgcgggccgatgttgcacaatacaaaaccacggtagcgcaggataaaaatgcactggatttgttggtgggccaacccgtggcagcacatttactgccagtggcggcctctacattgccggaggtcatcaaagctgtacccgttgggctttcctctgatgtgttgttgaaccggcctgatgtattggaagccgagcataaactgaaatcggccaatgccaatattggggccgctcgggcggcattcttccccagtgtgaccttaaccgccagtgggggcgtcagcagttcggcactttcaacattgcttagtgagggggcagggatttggtcattagctccggcgattaccttgccgatatttgatggcggggcaaatcgggctgcactggaatattcacaggcacagaaaaccggctacattgccgcatatgagaaagcgattcagacggcgtttaaggaagtcgccgatgcactggcgcgtaaagcgaccattcaagaacaacgggcagcacagcaagcttacgtggcggcggcacaagaaagtgttgaactggcacaaaaacgctataaacagggaatcgatacatacttgaatatgttagatgctcaacgcaccttatatgccgcgcaaactcgtctgattgccgtgcaacagatacaaactaacaatttgattacgttgtataaagttttaggtggtggggtatctgacgtcgccaaagagtagacattttttcgcgggcatatttttagtctattgggtacatcgtagtctataaaatgccgctgtgattaagcgttaataaacatgaataacagggaggccagcaatgacctccctgttattacttgataaggcaaggctgtttacgacaccagttctaacccggcaacacgatgccagtagccgttacaatctgctttattggctacaggtagcggtgacagaccctgttcgttagcacggaattgatcgataacgctaagcgtctcaaggccttgtggcgaaagacggatgatatccactaacccctgcattgagatcagatcattgccgaggttatagcagtagccactttgggtctgaataccgtttaggatgaagacctgttgatcttcttgtgacatcaccttgcgcccttgtggatatttaatgcagcaggtctcgcactcatctttggcgcggtcttctgagcgagcggtaaagcaacgggcggaatacgccagcggcagatgaccgtaactcagaacttcaacttcaaattgatgacgaaatcctaacgcgtcgcactgttgcagtacattgctcaaccagtcacgggacagctcaaccggcatacaccaacgtatcatgccctgacggtgtaaaatgcgcagggtataggcgttatagcagttcagggcgtggccagcgacaaacggtagtccgcgctcggcggccatattcaccgcgccgaggtcattggcttccagtaaaaactcgccattctccacataacgtttcagttcattcaattcggatggtgcctgtaacagcgccagcgtagaaatcaccacttgtttgccgctgcttgcgacggctttggctaaggccaaccagtcaccgaccttcatttcacggcgcttggtacagacattttcacccagataaataatatcggcactgctgttggccgccgcgtgataaaaggtttcaatctcagtttttggccagtaatagagtactgcgcctaaggcgtacttcatatttcctccggctactgccacttacgatgataagcgcccagtgttgtctgggtaccttcggacattgcgctcagttgctccatccattctgctttggcggcaaattgcgccggattcgcctgatagaggtcaatcgcctgtcgccagactttggcaacctggctgacgtaggctgggctgcgctggcgtccttcaatttttactgaggcaatattggcagcaaataattcgggtaatagctcaagggtattcaggctcgtcggctcttccagtgcatggtagcgctggtcatctacccgatagcggcctttgcacagtgtaggataaccggcattttcatggtcttcgtagcggtcaatcaacacgtcgttgaggcgggattccatcccttgtggggtttgttgccaacgtacaaagcgtgcgggcgagcaagcacccacggtattgggtgattcaccggtcaaataggaagaaaggtagcaacggccttcagccataatacacaaactaccaaaagcgaagacttccagcggaaccgggctggtacgtgataactgttttacctgatgcattgagagcacacgcggcaataccacccgggcgacatcgaaatggcgttgataaaagcggatggcttcatcgttggtggcagaagcttgtaccgagacatggcgctcaacctgcggataacgttcagcagcatattccagcatcgccaggtctgccaagatcagcgcatcagctccaagttgtgcggccatatccaccgcccgttgccagcgtgcatagccgtcagggtgggcgaaggtgttaatggcgatatgtaatttacgtttacggctatgaacgtagttaacggcttcttgtagctttttatcggtgaaattgaggccggcaaaatggcgggcgttagtatcatctttcaaaccgatataaaccgcatcggcaccattgtcgattgcggcctttaatgcaggtaagttacccgcaggacacagcagctccatagaatttccctgatatacccctcatacttcaagttgcagattcaagttgcagatgtaagggcatagatgatcttggtattttatcgagcggcaattttagttaacctcttcacatcgcaccttgatttaaggcagtttctttcgcattggtgacactcttctgatatttagcaatacatctgaagatgttctgatgcaaaatttgtcgatatagcccattttcataggttagcaatgtggcagaatagcggtacttggcattgtcattttattcagtgctatcattttattcaggattacaaggagtcactgcctgtgttgggaaaactacgagcacatcttgtgcgtcaagggccagcgctgctacgaggtccattaaaagtcacaccatttgccttgcagcgtcaggtactagaacacgtgttgggctggcaattccgtcaggctctgctggacggtgagttggcgtttcttgagtctcgttggttaaaaatcgaggtccgtgaccttgcgttacaatggtttgtgacggtagaaaatggcaagctgctcgtgagccaacaggctgacgccgatgtcagctttagcggtgatgccaacgatctgatcttgatcgctgcccgtaaagaagatccggatacgctgtttttccagcgccggttacgtattgaaggggataccgaattgggcctgtatgttaaaaatttaatggatgccattgatttggaatccatgccgacgctactgcgtgttggtttgcaacagttggctgagtttatcgaagcgggtcagcaagagggcgcggtggcaacttcccgcggactggcatcgtgttgatccgggttgaaattccggttgatgcgccggggatcgatgctttactgcgtcgggcattccagcagggtgatgaggcggagctggtacaacaactgcgcgaagatggcttgctgacgcttgggatcgtggcgacggacgatgaaggggtcgttatcggttatgcggcgttcagcccggttgaggttggcggtgaagatcgccaatgggtcgcattggcaccactggccgtggaagagggcttgcgtcggcagggcttgggtgaaaagttggtgtatgagggccttgatgccctgaatgagttcggttatgccgctgtggtagtgctaggtgcgccagcttattactcacgttttggttttgtaccggcagcccgccatcaactaacctgccgttggcccggtagcgaagaggctttccaagtatatgcactggcagaagacacgctggttaataccaaaggcgaagtggtgttctctgccccattcaatcgcttttagccgcaatatgttgcaccgttaattcggtttttactgtcaataacggcattaacgaggagggctggtcaatcaccagctcagactgctgacaaagtcaattgaaggggaaacgtgccgttggggtcgtagtggcgtaagccaccggagtgccccgaggtgcggtcaacccttcattcacgaggctaaaaatagcgttgtcaataacctcggctggtcaatcaccagcttttctttttgctgtttactgagctgcttgacgcggtactccagctttaaggcggtcgaacggtcgcccgcttcacaatgaaataccaacgttaactcccctttgccccgcagcgcttttgcccctttccccgcctgatgctgtgccaaccgccgtgctacatcggtggtaataccggtatagagcatgccactggcggtacgcagcaaatagagatgccaaaggctatctgacataatcttattccagtccgagggtaacggttcggcatgttatcaccggaacagcgtattgcatcctgactttttatctacccgtcgccaatcgggttaatgccacgagcgtgtcacgagtgaacgacgcgccgagtgccgtgggcagaagaccgtgtaggagaaaaaaacagagagtagacgacgtcgtagacgcggggcaaaagcggccccgcgatagatacacctagctaagatggatacgcctggctaaattgcggcagttggttgctggttaaaggaaggtttatccgcatggtttgctgttggcggattaattctattgataatatttcgccgttagtttccacctcaacgtgcagtaacgggttactgtcattcaagtcaaaaacacaggtgacctgagctgctggttgttggttgcgtaacatcaggtagctgagatcacgtaccgatggattcgccggggccagcccttgaaatagcgtggcatcagcggctaaccacagtgtcagtgggcgtgctgtggtttggtaacggcacggtatcaccccatttagtggttgggcggtcacctgatgcacatactgcatcgggccgctgtcaccgaaggacgtcatttcacctttctgttctgtcgcagtcccatcgatatacagcgtccagttccacgactgctgatggggattaacgatattgctaatatcgataatcgtatcttccagccataaaatacggcggcggaatttaacatcacgataagacgcttcatcccattgtatgcggatatggctgtctaacttaggcgctgtttgacgccaatcgacctcggtatccagccaactgaagtttgccgcctgatgccattgacggatgtaaggcactgcaggaggctgatttttttggttgatactgagcgtattgtgagtggcgctgtttttgtagtagtcataatgtcgctgtgcaccataaccggtggtgcctaaatcgggcaggacttcgtggcccctgtcaaacagaatcaaatttagccgatcataatgatcatgctcgccgccatacgggctgtgttttatcaacaatgcgcggctggcctgcggttggcgtaggatggttaatccgcaatctggtgcatgtagtgtatcggtcgggatgacatcaataatttgcagtggtaatgattcagccccatacagcagtgcatccagatttaaacggggttgctggcgataaatatgttgcagggccgccgcatattcacggttgccgtagatctgataagcaaattcatacagatgcgcatgattaagttgctcttgcccggcggtacaatcattaatgcgcgggaatgtgccgttgggcatcagcagcttgagcgggaagctgagcatgtcgcggtaatagggcagcgccagtaggctatagcggctaccggccgccagtttttcaaatgaccaaaaaccttgcagtgcataaaagtgataatgcaccgagccttcaaaccacagcccttcgttgaataagccatgctctaactggtagcgcaggccgtaatctgcgttaaccgcaaactcaatgtagtgctcctcttcaaggatcaggccaataaccgcgatagcgctactgattttaacttcatggttgtgcaactgacgggtacggtgttgcattaagaaatcagcgcccacccgcaataagcgctcagcaagacaatcacgttgctcttggctgagcgtatcagcgataaagtcatagcccaaggcaaaatcaaggaggcagtttgcctcacacagggtctgtgcattcgccttacccggcccgttataaggaataccaccgtggacttcatagtcagggtagtagcgggcataactcatcagaatgtcccgcaccttatcgaagtaacgtatttctccggttaattgccacagcaagcccagttgattgcaggctttggcgttcaaaccatttaatgcccgccaccaggcaccgtcgtagggttcgccgctaaaaagatgatcatctaccggacagcggtgtgcttgaggtgaaaagcgatcccataccaactggacaccatgctcagggcaataatagtaatgattccaggtggcgataccggtggcgggcaccagtgtgtcggtctctaaaaccacctgattatcggcgatcagcgtggcaataatctccggttgtttcacaacgcgctggcggattttaaccatctgccgatccgtaaactgcttcatatctggcgtgtcctcggcgatgcttatttttgcgttgtgattgggtaaagtaagatttcaacggtatctgggtattttgctatcaggtattgtgctttttgttggaattcaacgtcagcagggtaggcgcgagcggcggtaatcatattgaccaaggcttttttatcctgtactccatccagatctttatacggccaggcttggtcggtattgatgaaaccggcaacgtactgatagccttttttcaggctgtgctcatccagactgaaatcccagatatctttctcgccaacctcaccaagacggcccaatttattgtaggcctctagatggaagttactgtaatgccatgggcgggtgcgctccagctcggcattttgtcggccttgcatatcaaaatgtgagggaatacggcgtaattgcgtgatttccaaacgtttctgtgcagcggctttttgatcgctgaacagggcaaaagaggccgcctgcatatcaaaataggtgccgtggttattgtgccagttatcttcttcgaaaccattttggctggtggtcatccattgataaaaatcaccataccaacttttaatggcctgatagtcgctgtcactgagaacattggcgggtctgatcaattcaacggcatcaatcacatcaactagcgcccggctatcgatcaaaccaatacctcggccttcgttaatccccggaatggcctgcgcatattgcagattcggattcattttagtctctggattcacgaaccaattgaccaattgttcatgcgctttttgggcatactcaggcttaccggtaaagctataagccaacgccagataatagacgtcttcactgaagctgttcatgcgctttttatcggtggcatcactgttggccgcaggatttgtttccccatccttacgtaaataaggcataccgtctttcttgcttggatctggccaccaataaggtgggaagctgtaatagtcgtgtttatcaccactggcggccaagaggcttttatccatgacggagtacagtggtttttttagtgccttgtcggccttagccatcagatttttataagatttttcatataacgggttgttttgtttaatctgttcaatgctgtagttaatatcgtccatttttaataacaacggatgactttctgcagcataaataaagggagatgtacccaacagaatagtcagtaataggtttttagcaccagagtttagcatcatcactttccttatttttatggattaaacggtgtaaataaaaaattattaatttaatatattgatcactcatgttttaaataaaaattgtacttatttataatgtggttatttaatcaattcgtgggtgatagagagaatgaattccatctaatttatatttcggttgaattctaaggcaaagtttttggacttttgtgatccaagtctaccttatgaattatctattaataattgacttagattgtgactgccttcaaattaaatctctgttttaggtcttttcccgtcattttaagtcattgcatgttttttttaatttttaaaataaatcacctaacctactgtttttatgtgtttattaaatttttatcttttttttgttaattttacaaatgtgatctcaagcagaaatttcaaattggaattaagttttgttttttatggtgtagttttttgttttcctctgagttctaatgctatcacgtgttttacgattctgttttgttatttaaacttctgggtaaattcattaaaaattagatttcaacgaggatactaagatgaagacgcaaatgataatgtcaaaagtaaaaataaagtctttgctgttgttaacttatttagccatggggatcccttctcttcacgccgcagaaacattgcaagtgtggatccgtgcaagtaatgactctaaaaacatttataaaaaagaagctgacacgtttgagaaaaaaaccggtatcaaaattgaatatttcaatgccacgactgattttgaacaacgtctggcacgggccgctgcgggcaacgcgctacccgatctgattttcaacgatgccgtggctattggtcagtttgtgcagctagggattgtcgaaccgattgaaccaaaaaatattattggcggagagaacatcttcgataccgcctggaaaagtacccaatatattgatggaaaatattacggggttcccacctccgctcaaacctttgccttatttgttcgcaaagactggcgggaaaagttgggcttagagcaaccgaagaactggcaagacattagcacgctggcgaaagcctttacctttaatgaccccgatggcaacggtaaaaatgatacttacggctttattttgcctggttcaacaacccgtggctacgccagttggtttatcagctcctacctttggcaggcggggggtgactttattcgcccagccggtgaaggtaaatttattgcctcgctggaggagccagcagccactgaaaccctgagtttcatgcgcggaatggtgtgcgataaaacagtccagccgggggctatcaatgcgaccaccgctgatgcgatcccttcattccgttctggccaaagtggcatgttcttctccggcccatatcacatcgcgttgtttgataaagatcccggcaccgaggcttttgaagtgatcccgccaccgacagggccgaaaggacaggctacgttggctgaaggcaccacggtctttatgatgaaaagcagccagaaaaaagcagccgctcagaaattcattgagttcatgatctcccctgaagggcagcagatcggcatgggaatgggcaccaaaaacatgccagtcgtgcgcttgtcgatcaataaattggtggataccaaagcggtctatgacgatccacgttgggccatgttcgccgatctgtatgccgaacagggccgctatattccacaagttcctaactggacacctattcgtcaggtcaccgctgaaggtttcaaccgtattttagccaactgtgacagtgatatcgccgcagaattaaaagcggtgaatcagaaagttaatgatgagttggctaaacagaacgtcttagggcagtgagtgaataatgataacgctaaccccccgactgaaacgtaacctggttccgtggctgttcctggccccggcactggtcatcttcacctggtttaaattcatcccgatgttgcaagggctggtgatgagtttctacaaggttaactttaaccagccaaacgagtgggtcgggtttgccaacttttcccgcgcctttggtgatgaagcgctgcactcggctgttttcaacacgttgttatatgtcctggtcaccatggtggtggccgcgtttatcgccttctttctggcgatgttattggaagggccggcacggcatttgcgttttattcgtaccgccatcttcctgcccgcagtgaccagtgcggcgattgtcgccgaaatgtggcgcattctgttcaacccgaccagcaacggggtggtgaaccacgttttatcgtggttcagcattgaagcgcaggggtttctggcggataccgatcaggcgttgtggacagtaatgctgctgcatatctggaaagccgtgccttacaacatggtgatttttatcgccgggctggtagggattagccgtgatttatacgacgcgtcaaacgtggatggggccaactggtggaaccgcctgcgttatgtgacgttaccgggcatgatccccgcgctctctgtggtcctgatgctgtcatttatccgtggctttcgcgtgtttgccgaagtttacgccaccactggcggtggcccgtctaatgcgacggaaatgatcatgacgcatatctataaattgggctttgagcagtttgattatggttatgcctctgcggtgtccttcctgctatttgcgttcactgtgatgctgacgatgggtcatctcaccttgaaaaagcggatcgcccgttactaaccgagccggagactggtaatgaaaagtaaaagctggaacagtatcggccgttggataatttatggtctgctgctgattgtctttgttggcccgtactggggaattattgccacggcattcagtggtgcaccggtgaaacccggtgaattgctggcatggcccaatcagttctcatgggataactttatcttcgcctggatggatatcggcgtctggcaatacttactgaactcgatcattgtggtgttctttggcacggtgttgcaggtgtcagtcagtgcgctggcggcttatgcgttggcccgtaaaaagtttgtcggggtctccttgaccagtctgatcatcctttcgaccatgatgctgccggaagaagtgatcgccattcctttgtatatgatcatcaactggcaactgccggtgatcgatgcctcgctgtacaacagctatctgggcatgatcctaccgattgtgggctgggccttctctatctttgtattgaccgaatttatggcggcaattccaaaagagctggaagaggcggcgcgcattgacggtgccagcgaatggcaaatcttcttccacgtgatcttgccgttggttaaacctgcattgggtactgtggtgaccttcggctttatcatgatttgggatcaatacctgttgccactgattgtggtgaatcaggacagtctgaacaccattccggtgatcctcggcacactccgtaccgatgagagcatcaccccgaacatctttattgccatcacgctgttggcgatgttgccgagcatcatcgtgtatctgggtctgcaaaaacatttcaatcgcgggatcatgtctggcgcggttaaaggctagggagaaagaaaatgggatcggttgtacttaaaaatgtgtgtaaatcttacggtgacatccatgtgatccgcgatgtatcgctggagatccctgatggtgagttctgcgtgctggttggccctagcggttgcggtaaatccaccttactgcgcatgattgccgggctggaggagatctccggcggcacggttggcatcaatgataaagatgtcaccgatgtggaaccgaagatgcgtgacatcgcgatggtgttccaaagttatgcgctttatccccagatgacggtgcgtgaaaacatgggattcgccctgaaaatggctaagatgtccaaagccgacattaaccaaaaggtcgaatcaaccgccgagttgctcggtttacaagcgctgctggaacgcctgccaaaagatttgtccggtggtcagcgtcagcgggtcgccatggggcgggcaattgtgcgtaacccacaggtgtttctgtttgatgagccactgtcgaacctggatgccaaactacgcacacaggtgcgtggggagatccgcgaactgcatcagcggctaaaaaccacttcagtttatgtgacgcatgaccagatagaagcgatgaccatgggccagatgatcgtggtcctgcgtgaagggcgcattgaacaggttggttcaccattggacttgtatgaccgcccggctaacctgtttgttgctggctttattggatcgcctgaaatcaaccagttaaaaggcacggtggtacaagagggcgataaattcctgctgcaattggaggacaactcattactggccttgcccactggattgaacgtcactgaagggcaaaacgtggtctacgccatccggccagagcaggtgaatgtggtagatgaaacgcactgtgccagcgcattgaaagcgaccattacggcgatagaaaatacgggctcggatatgcagctcttttgcagcacgggcgggggccgctttacctctgtatttaaacaacgtttagcggtgagcgaaggggaaacggtctatctgcaacctaagcttgcgggtatccatatctttgatgctgctacggggttgcgggttgactgccaggcggcataagggaggccatattcatgacgccaataaaaacggcagtgacagcaatgaaactatacacattggatgttaactgcctgatcaaagctaaggcgatattgcagcagcctttttcacctctgcaaccggcgttacgtcggttattaagtgaagcggatatattgcgcgatcagtcgcctgaaagtgtcacccacaagacgttactgcctgtcagtggtgatattcacgattactatagttttggcacttattggtggcctaacccgcgcaagcctaacggtttaccctatgtgcgtcgcgacgggcataccaacccgcagagccagaacgatgatacggatactcagcgtatcgcacggatgtgtgaccgctgtttgacactggggctggcctactattttaccggcaatagccgctatgcacaggtcgcggcagaacagatccgttgctggtttttggatgccaaaacccgcatgaatccgcatctcaattacggccaggccattcctggaattgtgtccgggcgcggcacgggcttaattgatactcgcatgatgtggatggtgatcgacaccctgggcctgatatcaccggccaaattgttggatacagaagatacggcggtattgcagcagtggttccgcgactttaaccactggatgttccacagcgaagtgggccattctgaatatgtctggcataacaatcacggcacttggtatgacgtccagcgtgcggctaatgccatgttctacggcgatcgtgggctggtaaccaccattatccgtcaagggatcacgcaacgattggcggcacagattgcgcaagacggtaagcagtggatggaattggagcgcaccgtgcctttccattactccttgtttaatatggaggcccatttactgctgtgccgctacggggaacatatagagattgatcgctgggaatgggtacaagacggtcgcaatgttcagcagggggttgattatctgttgccgtttattgctgaaccggaactgtggccttaccgtgacttgcgcggtattgattatgacagcgcattgcggctgctcttgcaggcggcacggggctacccccaggatgccaaacgttatcaagccgtcttagccactttcccagccgagactctgacatcccgtgatcgcctgttgtggcaaagttgaaagaggcaaagttgaaagaggaaaagttgaacacgggaaagttgaacgcgggaaaattggcaggtcagatcaaatagtagaagaaaatttcatgtacactgaacgttgtttttacgccggagagtgacgtgaataatcctgatgacgtgctgttgatcaaccgcttcctgcgccagcaacatgtgttgaccttatgcgcgggcagcggcatggatatgtggtgcgctagctgtttttacgtatttgacgaaaatcagatggcgctctttctgatgacagaaaagcacacccgtcatagcgaactgatgttgataaacccgcaagtggctggcacggttgccactcaatcccgcactatcgccttgataaagggcattcaatatcgtggtgacattagtctcttgagcggcgatgccgaacaggcggcccgcaaccgctattgccgtcgttttccggtagcgaaggtctcttctgcccctctctggcaactcaatctgctggaaatcaaaatgacgaataacgccctcggctttggtaaaaaattgcattggtcgcgtgtggagccgttatgagtttgggctgcaacttttcgattattaactgtgaataatgctatttttgcctggtttattattcttataaatcccacttcactcgcaccctgaccgctttaagtatgaaggggataggtgttggggcacttacattttttcgggaggtcagatggcgaaggtattattactgggggcgagtggcctggtaggcggcgaattattgcgcctgttgcgtttggatgcccgagtgacatcgatcattgcaccaacccgtaacccattgcctgctatgaataaattgattaatccacacggcgaaaatatcggtcagttgctgaaaatgctgcatgagcccgtggacttggtcttttgcgctctggggaccacccgcaagcaggcgggcagtcaggcggcatttcgtcaggtggattatcggctggtattgctaagcggtgaaaccggccggcgtctgggcgcgcggcatttcctcttggtgagcgcattaggggccaatcccgattcgtggctgttttataaccgcactaaaggggaagcggaacgggatttgcaggctcaaggctggccgcaattgaccttcgcccgcccttcgatgttggccggccaacgggcgacgccacggttgttggagaacctcagcgcccctctatttgccttgttaccggctaaatggcgcttgattaacgccaaagatgtagcacaagcgatgttggatcaggcatttgctccgccgcaggagggcgttacggtgttgtcatctgcccaaatgcaaccaaccttgcgtccttgacgccgcagggggggctgtgcgtccgcgccccttattcgcactaagttataccagcgtaaccgtttgattatcataggcaacgctgaccccggtgggtagcgagttgttgaggagccacctatccaactggtggctggcgtgtgtcagtagcgtctcctctggcatcaataaatccctgatggctaatgccatggtcacatcgttatgattgcgtggcggtggtgactgtggcgcatggctgcaatccagcaccagtaggtcaatagacttactggccagaaacagtgcgctatcggcagatagcccaacagtatcggttaaataagcgatagcccggttggggctttgcagtaaatagccgaaagttattttggaatggaccaacggcacgggggtaacccgcagctcaccaaattgcaacggttggaaggcggtcagtggcggcctgaaatccaaaataccggggtgcttgaacaggtcgtcgcaaccgtccagatcgggggggccatagactgggatcttatttccgcacccccaacgtaatggaaataacccctgtacatgatccatgtgatagtgtgtcagcaaaaaacgctgaatttcacccgccctaaattgctgatccagtgtcggcaaacctgcgtcaatcaacgtagtttccccttggtaatacaacatcgcactgcaaggtttacgccgccgtgcggggtccacgctagcttgtgtacagatcacacagtcacagccaaataccggcacttgctgggcgcatccggtgcctaacagcgtcagttgcatggtttatcctcaacggggtcagataacggcgtatcaagggtcagtaattgctgtaattggttcagggtgtgttgtaactcaccgtcattacacagttgcaaacagtgagaaggaagttgctgctgatagtgttgcgcccgttgcaagcgggcatcaatttgttcgctattttctcgcccccgttgccgcaaccgttgtgccagaatcgctggggagacggtgagacagaggggtaacagttggtggcgatagcggcgttgagcttcaggtaaatacgctctggagccattgactaacacgtctaacccgtgttgcagccagaggttgatttcaatcccaatggcatagcagtgctgatgtgcctgccagtgcagcgcaaataagccctgttctgcccgctggataaattcctgtttgctcagcgccacatggttctctgctcccgcatctgccgggcgagtaatatagcgatgtgccaccaccctattttgcggtgtggcgtttcgcagtgcagataacaggcaatccttacccgcgccagaaggccccatcagatagattaaacgcgccatcagaacacccgagctccctgacgccagacgttttgcacataaacgttctcgccatgtgcgcgggccagaatcaagtcagcccgtttaccttcggcaatcacaccccggtcatttagccccaaagctctggccggattacgggtcaccaaattgaccgcttgtggcaaggtgaagcggttgctcgcgtcgtgtgcgatacggaatgctgcatccatcaggctggcggggtaataatcagaagataaaatatccagcacccccagagaagccaggtgatgagcggcaacattaccggagtgagagccaccacggacaatattcggtgcgcccatcaatacctgtaaaccgagttgatgagaggcggtggcggccacctctgtggtcgggaactcggcaatcacactgcccagcgcttgtgattccgccacatgagcggctgtcgcatcatcgtggctggctagcgcaatgcctcgctcgcgacattgtgcggcaatcgccgagcggttaggccctgcccaacgtgcggagagcgcgacctgctcttcttcaaacgccgccatctgcggatcgctaagatgatatttaccctgataatattcacggtatttctcacgcgaagcgaactgacgttgacccggtgaatgatccatcaatgacaccaacgataacgcaggttgcgccatcagggcttcgaacagtggcagagtattttcatagggtagttcacagcgtaaatgaatacggtgctcggcccggttcaggcccgcacgctggctatctaccacggcattaatcatcttttgcagattatccagccggtgacccccatcgcgcacatcaccaacggcaaccgcatccaataccgtggtgataccgcaggccaccatcagcgcatcgtggctgctcatcgctgaatgggcgggccaatcgacattgggacgcggggtgaaaaatttgtccagattatcggtatgcagttcaatcagccccggcagtagccagccattctcgccatctattgcggcgggtaactgcgtcgggcgatcactgtaactgcggatgacaccgtctacgatttccagcgatccactgactacgctgtcttcaagaatcaggctgacgttattgaggatcatacagggatctccgtgcggatctctgagggggcgggcgtcatggtaagtaaacgatcactgacatggttacgcacactctcatcgtggaaaatcccgacaatcgcggcaccgcgttgtttagcttcatcaatcaggctgaccacgactgcgctgttagcgctgtccagtgatgcggtcggttcatccaacagcaggatagggtaatccacaataaaaccgcgggcgatattaacccgttgctgttcgccgccagaaaacgttgaaggggccaggtcccacaagcgtggcgggacattgagacgggttagcaggtcctgcgcccgttgttggcaggtgtgccgatcaacgcccagttctaataggggctgcatcaccacatttaatgcactaatccgtgggatcacccgcaagaactgactgacccaaccgacagtatggtgacgcacggccataatttgtcgggcttcggcggccacgatatcgatccattctccctgatgtttgatccagatatggccgctgtcaggcagatagttggcatagagggagcgtagcagtgtggattttccactcccggaatggccgtgtagcacgacacattcaccgcggttcacctccagtgatatttgatgcagtaccggcagacgaataccgtgctggtggtggagcacgaaggttttgctgatattttcaacccggagttgtagggggttcatggtgggcctcggtttatgttttgtttcgctcggtacggttatttcactcagtgcaatggtttcgcttgccaaggcatcggttatccataggccttcagtgcctgcaatcgagcaggagggcaggccgcccctcctgcacctgcggctttgctcaacatccaatgcccactacgtgggttcccttcttcatctcttcggctttacgggctggctttaacctacatccctgtaggttgacgcctttcgccgacgtcctgtcggctcaccctacctgcgttcttcagtcggcgttggccgattcgccgttcaaggtcaacggcctaaaagtcaaaatcaaaaaccaactgcaaatgcaaaatcaaagagcaaaaatagagccagcagtggtttagttttgcagtaccgatgagaccaggagttgggtgtaggggtgatggggatcgtccagtacccggtcagtcaggccgctttcgataacctggccctctttcatcaccaatagacggttagctaataagcgggctacccccaagtcatgagtgacaatcaccacggctagctgcatttccaccaccaaattgcgcagtaaatccagtaaacgtgcctgcactgatacatccaagccgcccgtaggttcatccataaaaaccagtttcggatgggtcaccaaattacgggcgatttgcaggcgctgctgcatcccgccggagaaagtggtggggaggtcatccaatcgggataacgggatctcgacatcttccagccagcggcctgcaagttggcggatctcgccgtaatggcgctggccggtagccattaaacgttcgccgatgttgccgcccgcggagacttgtgggcgcaagccgtccagtgggtgctgatgtaccataccccattcggtacgcaacaaacggcggcgctgactttcggccatttcgtataaatcaaccggttgctgtgtacccgtgcggtaaatgatctgcccctgctgtggggctaaacgggccgaaatagctttcagcaaggtggttttacccgagccggattcgccgacgatccccaaaacctcaccgggatagagctgaaaagagacatcactgaatcctttgcccggcgcatataaatgagtgagattctccaccgacaacagcggctgaggggtagattgggctgacatcatcagacaggtacctcggttggggatgtggcttcttgtgcgctggcttgagccagttgctgctggcaaaaatcagtatccgagcaaacaaacatgcggctaccttggtcatccatcaccacttcatcaagataactgtggcgcgaaccacacagtgcgcaggggtcatcccactgttgtacgctaaacggatgatcgtcaaaatcgaggctttccaccttggtaaacgggggcagggcataaaggcgtttctcacgacccgccccgaacagttgcagtgcgggcatcatatgcattttgggattatcaaatttcgggatcggtgaagggtccatgacatagcgatcattcactttgaccgggtaggcataggtggtggcgatatggccgtaacgggcgatatcttcgtacagttttacctgcatcacgccgtactcctccagtgcatgcatttttcgagtctcggtttcacgtggctcaataaatcgcagcggttctgggatcggtacctgataaatcaggatctgatcttctgtcagtggggtttccggtatgcgatggcgggtctggattaatgtggcttcagtggttttctctgtggttgccaccccgctgacccgttggaaaaagcggcggatcgagacggcattggtggtgtcatctgcgccctgatcaatgactttcaacacgtccgtgtggccaatcagacacgccgtcaactgaatgccgccagtcccccagccgtaaggcattggcatctcacgcccaccaaatggcacttgatagcctgggattgcgacggctttcagtatggcacggcgcaatgtacgcttggtttgctcatccaaataacccaggttgtagccagtgagaacctcagtcatggtgtggctcctgtcgttgagaggatgatggtagtgaagatgatgatggtagtgaagatgatggtagtgaagaagacgataattgcggtgtgaaaagggcggatgacgcggccagatgttcactgcgtaggcgtttgagcagtgccagttccgcctggaaatcgacgtaatggggcagtttcagatgagagacaaaaccagcggcctcaacgttatcggcatgggataacacgaactcttcatcctgcgccgggctggaaaccgcttcctgatactcacggctttgcagggcgcgatccatcagcgctatcgacatggctttgcgttcaccacggccaaaaactaagccatagccccgggtaaaatggggcggttctgagaccggatcgacaaaaccattgaccatctcgcattcggtcaacaggatctcaccaatatcgatcgcaaagcccagttcttctggctgaatggcaatggtcaggtaaccggtgcggatctcggcggcgaacgggtgagtgcggccataaccgcgctgggtggagtaacccagcgccagcagaaagccttcatcacctctgaccaattgttgtagccgtgccgagcgattacagggataaactggcgggttccgggtgatatcatctggcggagtgccgtcatcttgctccggcagcgctaactgctcttgggtcagtaaatcaaatacgtgagcgcaaggctctggcaaggcttcttcgccacggggggctagcggcgtttcgccagaggccaacagggtaaaatccaacagccgatgggtgtaatcataggtggggccgagcacttgcccaccgggcagatccttgtaaatggccgaaatacgccgttccaggcgcatcgtgtcggttgccagcggtagactgaccgccagacggggcaaggtggtacggtaagcccgcaacagaaagatggcttcaaccaggtcaccactggcctgcttaatggccagcgccgccaattcacgatcatagataccgccctcggtcattacccgatcaacggctaaacctaactgctgctcaatttgctcacaatcgatcgccgggatctgagtatcgccccgccgctggttttccagtaattgatgggcggcggcaatggctttttcgccccctttcacggcaacgtacatcagcacacctccacatgagtggtccgtgggagagccatcaggtgctcaccacaggtcaacaggaaatcaaggccggcggggaacacggcaggccggttaagcggatggttcatgagctggcggtttattagcgggtggttcattaatagataattcatcaaaggctgaggcagttgcggtgaaacaatgcggttctgttcaataccggggccgtgtaagcgcaaaggcgtcccctgattcaggctgtccacctgaataatgaccgtgacagactgctctggtgagagctcattgcccggtgggcaggtggctaattgcacttcagtaagctcattgcccaagaccgcaaagcaggcagttgcgagatcggcggtcagtggcgcaccagtatgaaaacgcaggttgtgctgtaccccctcgctcgctatttggctgtccagatagagtggtgtctcctgatcggctagggtcagcaggatgctggtggttgcaggatttaacggttgccaaccggtagaatgcggtaatgtcacttgcaccccaggttcgctcagtgctttcagtatgcggcgaaaagcatactgggcctcaaccacaggctggtcaaaatgcgtcagtagactcatcaatcttctccccgaactaatgtgaagaaatcgactttactggcggcgatatgctgggcgcgcagttggcgtcgtttctgctgtattgcggcgagtgggtgaatcacggttttcagtaataattcgttcagtcccgcgggcctgcctttcagcgttgaatattgcagcaaggcatccaataacgcgcagagttcggcatggggcttattacgtccggcgatgtagctgtagccatagatatcggtgcagtcattgagtttgataaccgcgcgggtgaccgtcatatcaccgagaataaaacggcggccggtggcccccatccgcgcctgcaattgattaagacccatctcaggtgcccggatcacctgatactccggggatagatttaagggctgccagtgggcgagaagttctgtgggctggctatgggccaagatcgacagccaattttgccgggtcatcaacgtgctttccattcagtgctccatggtcagttcaatcatgtcggcgcgggtcaggctgagggaatattccgccacctgttggctatcaacacgggtatttagcgttcgcacgcacaggagcggcgcgtgggtggcaatctccagcagggcactctctttggcttgagcacgccgggcgctgatgcgagtttggctgcgtttcaaaggctgttgtaaatgttgtgcgatgaactgatgcagtgaacctgagtgaaaccgttgtagaactggccaccaactgagatcgggtaggtagtgatcgataatgcagaccggcacaccattaacccgcctcagggtgcgcaaatgaatgaccgattccccctctgtcagcgagagtgcttttgcaacaggctcagccgcagggcgtaaaacggcaagtaagcgctcactggtggggtcactgccttgatcgagtaggttctggctgaaacgcgcattggcatggagcgggtagtcataagggcgcatgagcaccagaatgccgatgccctggcggcgttgtagccagccgcgctcgaccaattcatccactgcccggcgcagggtatggcggttaacctgatagtggtcggcgagctgttgttcggagggcagataatcgccacaacggtaatggccgcgcaactcctgctctaactgggccgcaatatgttgatagcgggtgggatagctggtcggtggtctagataagttcatggcaaatataccctctcagcatcatcaccacgggctaccgctttttgtccaagacaacgacatgaaaagaaaaagcaggcgggcaggtggcggattgtcatgttgataaccggtaagttttctcaccgtaatgctggctgtttttgatgacagtggggttaagctaggatggcggaacgatgaatattttgctccccccacgtttcttatcaggaaccgcaggggcttatcaattaacgttgtgggtttgggctaacgtcgtgtatttgtctattaataatgaaaggtatttattaatggagcgtatttattaacgtaacgtatttattaacgtaaacagtgaataacctgattgctgctgccgcgccagataagtgaaggatctttcaggtcttgtacgaatttgccgtcgatcaggacgttgatcaaatcaaccacttgctgttgttcggcagtgagttcagccaaggtatagccggtccatagccagatatcttttccatcgcattcgtggtgcacccgttgtaccagttgaagaatggcggacaaattttgtggatgcaacggatcgccgccggaaagggatagcccttgccgccggatacgcgagtcgttcaggtcggcgatgatcttatcttccatctcgcgggtaaacggcttgccggaattgagtcgccaggtgcttttgttataacagccgacacattggtgcacgcagcccgaaacgaacaacgtacagcgggtgccggggccattaatcacatcgactgggtagtattgatggtaatttatagtaaatgccccccttcgtattggtagccgcaggcgtgttggttagctgggtgactcagcccatcagcaggcctcgcattgacgaggcctgaggttgtcgcctacctacaacgccaatgattttgggtaatactgttttgggtaatactgctttgggccatattctgcttagcgtttcagcccaactgcccgttagccagatgtttcacccggcgtttcacttcttcttgtttacccgcattaaatggccgtgcatctgggctacccagataaccacatacccggcgggtgaccgacactttcgatggctcatggttgccgcatttcgggcaggtaaagcctttgctggtacaagagaattcaccggtgaagccgcattcatagcactcatcaattggcgtgttggtgccgtaataaggaacccggctgtagctgtaatcccagacgtcttccagcgcccggatgttgtgctgcaaattagggtattcgccgtaacagatgaaaccaccgttagccagcggcggataaggggcttcgaaatccagtttgtcgtagggattcacttttttctcaacatccagatggaagctgttggtgtaatagcctttgtccgtcaccccttcaaccacgccaaattcagcggtatcaaggcggcagaagcggtcacacaagttttcacttggggtgctgtataggctaaaggcataaccggtttcatctttccaatcatcggtagcctgtttcaaatgagccacaatggcgatggctttttcgcgcagcttctggtcatcaaagagatgggtctgatggccgaataaggcattaatggtttcatgtatcccgatatagcccagcgagatcgacgcacggccatttttaaagatttcggcaatattatcatccgcttgtaagcgtacaccgcaagcaccttccatatacagaatgggggcgactcgtgctttgatcccttctaaacgggcaattcgggtcattagcgcttttttcgcgataagcaggcgctcatccagcaactgccaaaattggttttcatccccttttgcttccaacgcgatacgtggcagattaaggctgatcactcccaaattattccggccatcgtggatttgttgaccctcctcctcatacacgccgaggaagctacggcagcccattggcgttttaaaggagccagtgaccttaaccacttgatcataattaagaatatctggatacatgcgcttggttgcgcactccagcgccaactgtttgatatcgtagttagcatcgccaaatttgtggttcaggccatcgcggatagcaaataccagttttgggaataccgccgttttacggtttttacccaagcccgcaatacgattacgcaaaatagcctgctggatcatgcgtgattgccaactggtgcccaagccaaaaccgaaggtgacgaagggcgtttggccattcgcggtatgcagtgtattgacctcatactccagtgactggaaggcgtcgtaacactctttttcggtacgcgacatggcataacctgcaacatcagggatctgccactcttcggcgacagccttatgtttattaaagctttccgtgacaaaaggggccaaaacttcatcaatacggttaatggtggtgccaccatagatatggctggcaacctgcgcgataatttgtgcggttacagcggttgcggtagaaatggattttggcggctctatttccgcattacccattttaaaaccttgggttaacatgccttccaaatcaatcaacatacagttgaacatcgggaagaacggcgcgtaatccagatcatgatagtgaatttcgccgcgctcatgggccagcaccacatcgcggggcaaaagatgctgtttagcgtagtgcttggcaacaataccggccaacagatcgcgctgggtagggatcactttgctgtctttgttggcattttcgttcagcagtgctttgttgctttgctccactaacccttgaatttcctgattcaagcggccacgcagttcccgtgagatatcacgatcatgacgatattcgatgtaagcccgggctaactgtttgtattgacccgccatcagttggttttctaccgcgttttgaatttcacggatatcaaccttcggctggttttccatcgtttgagcgaccactcgggcaacggttgcacaataatcggcatcgaccacgccaacagctaatgctgcgcgctcaacagcctctttgatacgaacttcatcaaaaggtacctggcagccgtcccgtttaatcactactgttttcacaatgtcactcctgtataccgccgcatagggttatccacaaggcaacccgcagcacatcagggctgcgagggggatgtggatgcttttgtggataactactacatatagatgcttaaaatattatagacactatatatgggtatctggatgagtgacagtcaactgatagccaatattgttgacctagaacaaggaaattggcgttagggttattccctgttcagtacgtcacagaattgtgatttttatggcgagggattgtattgacgaaaaggttttgtgtttatgaaaaggtcttgtgtttacgaaaaagtactgtattgacgaaaaggtatggtgtttacgaaaaggtcttgtgttgatagggttcgcctgataatcgattttttctctttactggccgcgtcatgtcacctcaccgaatcaccaaaacttaccccatcgaatgctccgccgacgctaaatcctcccgtgagtactccctgacaatatggccgttttccatcaacactgcgcgctcagacatatgtgccaccacatcgctgtcgtgactgaccagcaaataggtcatgccgtattcgcgttttaaatgattaagcaggttaagaatttcggcctgaacggacatatctaacgctgaggtgggttcatctagcagcagcaatttaggccgcagcagcagagcgcgggcgatagcgatacgctgacgctggcctccggagaactgatggggataacgtaaagcggcagacgcaggcaaacccacttgttctagtgcctgcgcaattcgctgagcgatatttttctcgccgtggatctttaacggctcacctaaggtgcgttgaatattatgttgagggtgcagcgaggcatacggatcttgaaacaccatctgcacatctttacgtagttggccggtgaaacgttggcccggctgtaaccgctggcccagcaaggtgatttctccctgccattcgcgctgtaacccggccagtgtccgcaagacggtggattttccacagccagatgccccgatcaggctgaatgtttcattggcttcaaccgcaaaactgaccgattcaaccgctgttttgatctggttcttctgggcaaagctgacctgcaaattgttcacttcaatcagtgccacgggagcctccggagaaatctacgctgcgatccaataccggcagatcggtgccataggtatgggcattcgggcggcaagcccatagcgtgtgggtataagggtgggttgaatggggcagatcagcggccagaccttgatcgaccaacttcccctgatacatcactaacacgcgatgacaatgttcggcgactaatggcaggtcatggctgatcagcaacaggctcatttttcgttgttcggtttgctcaacaattaattcaaggatctggttgcgtaatttggcatctaacgcggatgtcggttcatcggcaattaatactctgggattattcaccaaagcgattgccagcatcgcgcgttgccccataccaccagaaagctggccggggtagctgtggtaagcgctggcatttaacccaaccgaggccagtgcatttaatacccgttcatgcgcatcagcgcttgaaagggtgttatgcagcaacagagactcttcaatctgcttaccaacaggttgtaccggatttaaggcataacgggggtcttgtaacaccatagcaatttcactgccccgtaatgcgctccattgcctggtgtttaggcgcagtaaatcgtgttcaataatctgaccggaatggccctgatcatccgtgttgtcagagtaataactcagcttcttggcactgactttaccggggtgcctgactaagcccatcagcgctctggccgtgatcgatttcccggagccggattcgcctacgagagcaacacgttcgtgaccgaggtggaacgaaatgttatccaccacccgctgttgctgaaaatcgacgcacaggttatcgacggtaaaaatagaatcagtcatggtgaggatccagaatatcgcgtaggccatcgcctaacaggttaaaggccatgctgctgagtaggatcgcacaaccgggaatggccgcaatccaccattggtcaaaaatcacctgcatcccatcggcgaccatcgaaccccactcagacatgggtgggcgagcgcccagccccagaaaacctaaacctgctgctgctaatataatgcccgccagatccagtgccaaacgcacaacggcagacggtaaacacatgggcaatatgtggccccacaggagccgtagccctcggatgcccatcatttcagccgcagctaaataatcacttttacgtaataactgaatttcggctctggcctgacgggcatacgccggccaggttgtcagtgccagcgctaatgcgccgttcagtaaaccggggccgagcatggcaacaaaagcaaaggccagaatcagccgtggcatcgacatcaccacatcagtgattcgcatcagaatgcgttcgagccagccgccgtaatagccagaaagcaccccgaccaacaaccccagaggcaatgtgatcacggtgaccagcagcaccaatcccaaggttggccgggtaccgtaaatcagacgcgacagcatatcgcggccataactatcggtgcccagcaagtggcccgagtcacccggcggcaacaaccgatcggctgcgttttgccagttagggtcctgtggagcaagccacggagcaaaaactgcaatgataaccagcagtgatagaataaacagacctatgctggtggacggggaacgcttcagcgtgcggtagaactttattattggcatatcagcatcatcgacatatcagcgcgttctcggatctagcaggcggacgagcagatccgtcacattgttaatcaaaataaagcacataccgagcagcaaggttccgcccataatcgccgtggtgtccccggcaaatagggcgctggtcaggtagcgaccaatgcctggccaggcaaaaacagtttcggttaacaccgcaccttccaacatactggtataggccagcgcaatgaccgtcagtaaggtgccacgaatattgggcaggacgtgcatcagtaaaatacgcatttcacctgcgcccttggcccttgccagcgtgatgtactctttattcaattcacttaggcaggccgagcgggtcaggcgggtgatactggctaacgcatagtaagccagtagggagaccggcaaaatcatgtggccgagagcattattaaaggcccccatatcacctgatcgccaggtatcgatcagcacaaaaccggtcttggcttcaacagtatattggtagatatcatccagacgacccggaccggggctccattgcaaccgcgcataaaacagcagcagcatcagcaagccgagccagaaaatgggcactgaattacccagcagagtgataaagcggatagtgatatccagcttgctacctgcccagcgggcgcacaataaaccgaggaaaatacccagtgcaccgcccacgagcagtgataaggttgccaattctaacgaggcagggaagacggtcagtagatcctgtaataccggctggccactggcgctggcgacccctaaatctccatgagccaatcgcaccagatagtgccagaattgtacaaataatggctggtccaacccgagttgctgtttgacctgttggtaagtggcttcactggcgtgatcgcccacaatttgcaggactcggtccactggcgacagtgccgagaggaagaaagtgatcaccaacaggccgaatagcgttagggccagggtgaatagcccctgtaaaaaaaccaaaagatgacgccgggagggggttcccggcgtggtatttaatgctacagacattgactatcggctcgcttgtcgcttgagttacatgtgttccacaaataactaatatcacatctaactcatttcacaaataagtcagcacaagggtcttatttactgacacgatcataatagaccatatcggcattcagaccttgttgatagccttttacattatctcgtaacacaacttgtgctttggcttgatcaataaagatataaggcgagttttgctgcagttcctgctgtaactgggtgtacaactgagtccgtttttctggatctgcttcagcgacggcagccagtgtttgcttattcagttcaggaataacccagccgtttaggcccgccaccgtactgcttttaccgtcgttataagcgaaggtgctggcattggagtgtgcatcgaaataatccgggatccacaggcgaatcgccgattgatgctgtttagcccgcacccgaccataaacttggctacctgctgctggcagcaataccagtttcacccccccctgcgcaaagctggcctgtaacgactgagcaatggtgataaacgggggtttgttctcaacatccagtgtcagtgtggcatctttaatgcccgctttagccagaatttttttggcggtggccggatcaaaagtgaatggattgcttgccaatgccccaggcaaaccgacggggaggaagctttgatgaatgaaatactgatctttcaacagatctttggtaataccttggtaatccaccagataacgggctgcttgccagagttctggcctgctcagcagcgggttagcggcattagcggtgttaaacaccaaatagttttgttctgctgatgggatttcaacgaccttgacgccggcctgtgttttcagcgcagtaatttggtccggccctaattcccgtgcaatatcagcatcaccttgttgaattaacaggcggcgggcactggggtcaggcacgtttttaataataatattcttaattaatggctgattacccggtgacgtagggttggcatccagcacaatggcttggtgcggctgataaacccgcattttgaaggcgccgctaccggcagagtgcattttgagccacgcattaccgtaatcgtcatctttggtattcgccgtcacggtttttttatcaacaatggatgcaatgggcgttgataaaatattcaaggcaaccgctgggctgacatctgcactccagcttacttgcacggtattattatcaattttctttaggtgttgatcgatgttatcagcctgccagcccaagacgttgagaataaaagcaggtgagcgattcattttcactgcgcgggtgaaagaataaatgacgtcatcggcttgtaccggattacccgatgcaaataccgcctgtggacgcaatttgaccgttaatgttttggctgcggcatcgccttcccagctttcggccaggacgggtactacttttgccgggttatcgcggtcggcttgaactaagcgctgatagaggctcggtactgtctgaatgctagacagctcgttactttctgcggggtcaaggctgacgatgtcatccagggattgcacgactatcagcgtatccggcggcgttgctgccaatgtgccgccagataacgctgccagaacgaataatgacagaacttttgctttcattgagactcccaagaatagattaccgccatcgcgtgtttctagtattaagtagttaacatcgatagaaaatgagtgtttttttatttatttcaccgcagcttgccaccataatcactttactgtctgtggtaaaagtctcaacagttatttgttataatatttagtgataataaaatattccgtaaaggaataatgatgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctgaatgatgatgttttttccagcaatagtcatcaccgccgcaacgccatcatccgtaggctgaaaaataaataatcagcaaatatcccattttatgaatgccaatctacttatacccgtcgccctttaagatgcaggggtgttagctgcccttgctcaccccagtcactgagttatctaagctcctggggatttactcggttgctgcctacctgcatcttgaagtaacttgggtatataataaaacagcatttcattttcataagacaagggaacatcatgattatcggaaatattcatcatttggcactgctgccttatctgccagcccaattgcgggacgccatcgagtatgtgaaaagccatatcaacgcagataccccattgggtaagcatgatattgatggcaataatgtgttcgtgttggtttccaatgacagcactgacttattagagaatcgccgtgcggaatatcacgccaagtatttggatatccaaattattttggcagggcaggaagggatggctttcagtaatctacccgcaggaaagccagataccgattggttggcagacaaagatattgccttcttacccgcaggcacagatgaaaaacacgtcgtgctgcaaaccggtgattttgtcgtatttttcccaggtgaagtgcataagccattatgtgccgtgggcgagccggcgaatgtgcgtaaagcggttgttaaaatagcggtgaaataggctatctcactggccagcttgagcttcggggcagtgctcgccgccgtcacgtactgcgtgtacgctccgttggctgcgcgctgtccgcactcaatctgcctgcgccgataacgcctatttaatctggttggctattttcattaattgatagcgaaaagcgaccagcttgagcttcggggcagtgctcgccgccgtctgaattttataggtaaagggccgatacagataacggatcagcccttattattgttatcggctacctttatattttgctcatcgtggcgaccatcacggctttgatggtatgcaggcggttttctgcctgatcaaatacaatgctatgagctgattcaaacacctcttcagtcacttccatgccgccgggtaaatcatattgttcggccatctgcttaccgatggtggtttggtcatcgtggaaggcggggaggcagtgcagaaatttaacctgagggttaccggtcagcgtcagtacacgcatattgacctgataaggtttgagcaaggtgatgcgttcctgccagacctctttgggctcccccatcgagacccagacatcggtataaagaaaatcagcgccgttcactccctcggcaatatcttctgtcagggtgattttgccccccgttttctgtgccagtgcctgacaactgataacgaaggcttcttctggccaacaggctttcggtgcgaccaggcgtaaatccattcctaccagtgcggccgcttctaacaggctgttccccatgttattacgtgtatcaccgaggtacgccaacgtcattttattcagcgatttattgggcagatgttcccgcatcgtcaacaaatcagccaggagttgggttggatgaaactcattggtcaggccattccagaccggtacgccggcaaattctgcgagtgtttccaccacgcgttgcccatagccacggtattgaatgccgtcatacatacggcctaatacgcgggcggtatccttgattgattctttatgcccaatctggcttccccctggcccgagataagtgacgcgagcaccttggtcatatgcggcaacttcgaaagagcatcgagtgcgagtcgagtctttttcgaagatgagcgcgatattcttaccgaccaatttttgctgttcacagccagatttcttgtcttttttcaactcagtagccaaatcaagcaaggcaataatttcagcgggggtaaaatctaacaacctcagaaagtgacgtttatagaactgattcatctgttcgtctccatgtgcccttcatccttgatgctacaacaccaattttttgggggtaaattgaatttcaatatgaatttaaattcaatttataggtataaatattcaattacaacccaaattaataattctttctcgtttatagtggaggcaatagctagggtgtgggaaaatggcgcaatataacgcccattaactgaggataaaggcatggcaaaccgcgaactgctagacgaacaacgtgatgagacccgcctgatcatcgaggaactgctggaagatggcagcgatccggatgcactgtacaccattgaacatcacctctctgctgagaaattcgaggtgttggaaaaggccgccgttgaagcgttcaagctaggttacgaggtgacagatgctgaagagctggaagttgaagacggctctatggtgatgtgttgtgacgtaatcagcgaagtcgccctgaatgcagaaattattgatgctcaggttgaacaactggtcgcattggctgaagcctgtggcgttaattatgacggttggggcacctattacgaagatccaaacgcagaagatgacgaagacggtgagtacgacgacgaagagttggttgatgaggatgacgacggtaagcgtcactaaattacccttcgtccttggcgctacagctgtgttagcggcactcacttacccgaatcacttacctgagtaagctcatcgggatgcgttcgtttgctgccttgctgtaacgccaatgacgttgggtaatccccttcttggggctacagttttttgtcatcccaagatggtagcggcacttatttacccgaattacttacccgaatcacttacctgagtaagctcatcgggatgcgttcgtttgctgccttgctgtaacgccaatgacgttgggtaatcccccttcttgaggctacagttttttgtcatcattaagggtgcatggcgccctgaaattcttgcaggggagggcttcaagaggttaaagcgttttcagcatcgtcacttcgcaatctacatggccggtattccccatcgcaccgccaatatgttcaaaacctaatctttcgtacagaccaacagcactggtcaggctggcagtggtttccaaataacagcgaccaaatccctgctggcgggcaaatgccaacgcctgtagtgccaactgtttcgctaaacccttaccacgcagtattggcagaaaatacattttctgtaattcgcatagatcggcttcaccgcccaacagtggcgcgacaccaccaccacccgcgatgtgaccatccacctcaatcacccaataagcgctacgtggctggctgtacaattcatacaagtgatcaagattaggatcggacacggtatagcctttgtccgcagtcaggccgaattctgccgaaacctcacggataacattggcaatggcgaggttatctcttgcggtgatggggcgcaccaggagtcggataggtgtggttgtggtcatgctctataaacccaaaggtaatatcttagtcataatctgtaataccatcgaatggtgccagggtgcaatggtaaaaagcaggggccatgatagtgaataattatcatggcccctggtgacgactgactgatagtttgattaattatagtgcagcgatagttgcctgctgctcaattaacttctgtttggcttcagcacaagcggccagtctttcacgctctttggcaactaccgcttctggcgcccgcgccacaaaaccttcgttacccagtttgccttcgatgcgctcaatttcagcatccagtttcgccacttccttcgccagacgatccaactcggtggctttatcgatcaggcctgccattgggatcagcacttcagcaccttcaaccaatttagtgaccgatactgggcctttatcaccttcagctagcaaggtgagagaggacaagcgcgccaatgactggataaaactctggttttccagcacccgacgctgtgcttgtgcgttggcaccccgcagcatgacctcaagtggtttacccggtgcaatgttcatttccgcccggatattacgcaccgcgataatggtttgcttaatccactctaaatcactgagtgcttgttcatcgacttggctggcatcatattctgggaaaggctgcaacataatcgtgtctgcagtaatgcctttcaggtttttcacccgctgccagatagtttcagtgatgtaaggaatgatggggtgcgccaagcgtagcaaggcttccagcacctgaatcagcgtgtggcgagtgcctcgcagttcagcttcagagccactgttcatcaccggcttggtcagttccagataccagtcacagaactggttccaggtgaattcatacagaataccggccgccagatcgaagcggtaggtgtccatcgcttcacggtaggctttgatggtctggttgaattccgccaaaatccagcggtcagccagtgataacaccatttcgccaccgttctgcccacaatcctgcccttcggtattcatcagcacgaaacggctggcattccacagcttattacagaagttgcgatacccttccaggcgtttcatatcccagttgatatcacggccagttgaggccagtgccgccaacgtgaagcgcagcgcatcagtgccgtgcggctcgataccgttcgggaactgcttttcagtgcgcttgcgaattttctccgccaactgtggctgcatcatattgccggtacgtttttccagcaacgcttccaaagagataccgtcaaccatatccagtggatcgatcacgttacctttggacttggacattttctgcccttcgtcatcacggatcagaccggtcatgtagaccgttttgaacggcacctgtggtttaccattttcatctttcataaagtgcatggtcagcatgatcatgcgggcaatccagaagaaaataatatcaaaaccactgacgaccacgctggtcggatggaaggttttcagtgcgtcggtttgttcaggccagcccagtgtagagaatgtccacaggccggatgagaaccaggtgtccaacacatcttcgtcctgacgcaaagcaacctcggcgcccagattattgtcgcggcgcacttcggcttcgtcgcggccaacatacacattaccctgctcgtcataccaggccggaatacggtggccccaccacaattgacgtgagatacaccagtcctggatatcgcgcatccatgagtaatacatgttttcgtactgtttagggacgaactggatctcgccgttctctacggcttcaatcgcgactttggccagcggggcagtgcgcacgtaccattgatcggtcagcatgggttcgataaccacgccgccacggtcgccataaggtactgtcaggtcatgaggtttaacctcttccaacagaccgagtttctcgaattccgcgaccaccgctttacgggcagcaaaacgttctagcccttggaactgcgcaggaatagcgttactaaatgcatcagtcgcttcaccgtgggtatcaaatacctcggcttctgagcggatatccccgtcgaaggtcagaatgttgatcattggcagggcatggcgcttaccgacttcatagtcattaaagtcgtgggctggggtgattttcacacaaccggtgcccttctccatatcggcgtgttcgtcaccgaggatcggaatacggcggccaaccagcggcaggatcacttctttgccgatcagatctttataacgtggatcttccgggttaaccgcgacaccagtatcacccagaacggtttctggacgggtggttgccaccaccagataatctttgccttccgcagtcttggcaccatcggccagcggataacgcaggtgccacatggaacctttggattcgcggttttctacttccagatcagaaatggcagtgcgcagtttcggatcccagttcaccaggcgcttgccacggtaaatcagatcttctttatgaaggcgcacgaacacttctttaactgcgttggacaagccttcatccatggtgaaacgttcacgttcccagtccacggagttacccaaacgacgcatttggcgagtaatggtgccgccggattcgcctttccactcccagattttatcgataaacgcatcacggccgtaatcgtggcgggtcttgccttcttcggcggcaatcttgcgttccacaaccatctgggtcgcgatacctgcatgatcggtacctgcctgccatagggtatttttcccctgcatacgctgatagcgaatcaaggtatccatgatggtctgctggaatgcatgacccatatgcaggctgccggtcacgttcggcggcgggatcatgatgcagtagctttctttgctggtatcgccgtttggtttgaaataaccctgtttctcccaatgttcatacagcggctgctcaatttcctgcgggctgtatgttttatcgagggacggctcagttttgttgatatgagaaggtgtattttccattttctttttatttcaattagttggcggcgttgccgtggtcaagtggaagccgacgctgcgataagatttatatcggtcgcgcgccaactgtttcaaattttcttcataaggcacgaagtctaccacttcatggaaagcggtggcaaaacctgcgaattctggcagcaggctgataagcaggtcgcgcggtgaattcccgcgtctttccggccacgccagttcgacgggagcgccatattttggcccttcaccggccagattatgtggcacaaattgttcaggagcgcgctgccagagcgcttcatccagccgctgagcttgttcctggctttcacaggcgatcaacacccgcttgcccgcccgccaacgttcagccgcgatctcgcaggccaacgcttcgtgcgctcgcagctcaccggcaggcgtgtcgtgttcgagcaggtagaaggtagcgtttttcataaattctctacaacgtaaagggcacaaaaatgtgccctcagactgctaacaaaatcaaatgaaggggaaacgtgccgttggggtcgtagtaaccgttttgcttgtcaacccttcactcactgttgtcgttaaccttaatatatcaaacgattaatcgtcgccgtttaagcccgcgcgattcagtaggaactgagacaacaacgcgactggccggccagtcgcgcccttgttcttacctgaacgccacgcagtacccgcgatatccagatgcgcccaactgtatttacgggtgaagcgcgataagaaacagcctgcggtaatagccccacccgcgcggccaccaatattggccatatcagcgaaattagagtccagttgctcgtagtactcctcacccagtggcaagcgccatgcgcggtcgcccgcctgttcggatgcgccgataagctcatgagccaacgggttgtggttcgacatcaaaccggtgaggtgattgcctaacgccacaacgcacgcgccggtcagtgttgcgatatcaatgactaactctggctcgaaacgctcaacgtatgtcagcgcatcacacaacaccaaacggccttcggcatcagtattcagcacttctacggtttgaccagacatggtggtcagaatatcaccaggacgataagcacggccacccggcatgttttcacaaccggctagtacacccaccacgttcagtggcaattgcaactcggcaacgacccgcatcacgccataaacggttgctgcaccgcacatatcgtacttcatttcatccatgccttcggcaggcttgatggaaataccaccggaatcgaaagtcagccccttacccactagcacaattggcttagcatctttatttgggttgcctttatattctatcaccgacatcaatgattcgttttgcgaaccatggccgacagccaaataagcgtgcatgcccagctctttcatctgctgttcgccaatcacgcgggtgacggtgttggtactgaaagcatccgccaattggcgagcctgagacgccagataggcggcgttacagatattgggtggcatattgcccaagtcttttgccgctttgataccggaagcgatagctaaaccgtgctggatagcacgctcgccactggtcaattcacggcgggttggcacgttgaagaccattttacgcagtgggcgacgaggctcggttttattactcttaagttgatcgaaggtgtaaagcgtttctttggctgtttctaccgcctgacgcaccttccaataagtatttcggcctttgacatgcagttcagtcaggaagcagaccgcctccattgaacccgtgtcattaagggtattgatggtcttttggatcacttgcttgtattggcgctcatcaagctcacgctctttaccacagccaattaacaagatgcgttcggaaagaatgttcggcacatggtgcagtaacagtgtctgcccgactttgccttcaagttcaccacggcgcaataacgcgctgatgtagccatcactaattttgtcgagttgttcggcaataggagatagacgacgaggttcaaaaacgccgactacaatacaggcactacgctgtttttccgggctgccgctctttacactgaactccatgtactctcctgaatcttaaagacaaaggtgggagctaccgttagaatatggcgctccgcaacgatctctctccgttgtgttaacgacgtgtgttaaccttaacggcataagttgttttgttttggcgactataagcatgttcctataggacacccaaacgctagatgttgtaatactattttagctgtgaaggttgccatatgatgagaataaatggcggattaacgatgaaactatcgattttcctgcaaaaagacaagttttcacaggcgtattagcgtgatcatcattagatatctggtacgggaaaccttaaaaagccaaattgcgatcctgttcatcctgctattaatcttctttagccagaagttagttcggatattaggtgccgctgttgatggtgaaatcccgacaaatgtagttttatcccttttgggacttggtgtgccggaaatggcacaactcatcttaccattgagcttattcctagggctgctgatgaccttgggcaaactgtacacggagagtgaaatcaccgtgatgaatgcctgtggcatgggtaaaaagtccttgatcatggcagcgttaattctggcgctcttcacctccgggctggcagccatcaacactatctggcttggtccttggtcttctaaacatcaagatgtcgtactgaacgatgccaaagccaatccgagtctggccgcgcttggcggtgggcagtttaaatcttcaaacgatggtaattcagctctttttattggcaatgtggcgggtaaagagtttaaccgtgtgtttttggcacaattgcgcccgaacggtaaccagcgcccctctgtggtggtggccgatagcggccatatgagtgagctcccggacggttcacaaatggttattctgaacaaagggactcgctatgaaggcaccgccttgctacgcgatttccgtattactgacttcgttgattaccaggctgttataggacacaaacaagtacagcaaagcagcaacggggccgatcagatgtcaatgaaagagctatggcgctctcaagaacctgatgcacgggctgagttccactggcgtctaacactgattgtttcggtcgttattatggcattgctagtggtgccgttgagtgtggttaacccacgccagggtcgtgtcctgagtatgcttccggctatgttgctgtatttgattttcttcctgttacaaagctccctgcgttctaaggcgggtaatggccaactggatccactggtctggatgtgggctgttaatggtgcttatttggctctcgcgataatcttgaacctgtgggatggcctgatggctcgtaaattacgtgctcgattgagaggtgctgcctgatgtttggtgtattagaccgctatatcggacggactatcctcaatactatcctgatgacgttattaatgttggtgtcgctgtcgggcatcatcaagtttgtcgatcaactgcgtaaagtcgggcagggggactactcggcggcctctgcgggtatgtacactatcctgagcatcccaaaggacatcgcggttttcttcccgatggcggccctcttaggggcattactggggcttgggactttagccagtcgcagtgagttggtagttatgcaagcgtcaggttttacccggatgcaaatcgcagcgtcagtgatgaaaacggcaatccctctggtgttgctgacgatggctatcggtgagtgggtggcaccgcaaggtgagcagaccgcgcgtaatttccggacacagcagatgtacggtggttcgttactctcaactcagtcgggtttatgggcgaaagatggctctgactttatttatattcagcgggtgtctggcgaaagcgagttgacgggtgtcaatatttatcattttgataaagaagatcgtctgctttcggtgcggtatgcggcgacggcgacctatgaaaaagacaataaaacctggcggttatcgcaggttgatgaatctgatttaagtaatcctactcaggtgacaggttcacagacgctgaccggcgagtggaagaccaatctgacgcctgagaagttgggtgtggtggcgatggatccagattcgctctccattagcgggttgcacgactacagtaaatatctacagcaaagtggtcaagagtctaaccgctacgaactgagtatgtggagcaaggtatttgctcccttctctgttgcggtcatgatgctgatggcgctgtcgtttatttttggcccattgcgcagcgtgccaatgggtgtccgggtggtcaccggtattttcttcggctttgttttctacgtgctggatcaagtttttggtcgacttagcttggtttatggcatcccaccaatgctgggtgcgctgttgccgagtatgttattcctcctgatcagcatttgtttgctgctaaaacggcggtaatgacgtttttttcagcacttagactaaacgtagtggaataacagttgcatgcggatcattggtaggtataattcatctcgttttccgcatactactacttcagtgccgaagtggcgaaatcggtagacgcagttgactcaaaatcaaccgccgcgaggcatgccggttcgattccggccttcggcaccattagtatgtaaagagacctcaactgaggtctttttttatgtctaaaatccagtccccgcaaggctcttctcgctttttcactcaacataagtcaacctgattcaatctacatcaacttactgatgtgggtacaattgcgggtatatcccggttcgatcatgtttgtacccacgcagaacccttgaaaggatactcaacatggctctgagtgatgtgaaggttcgtacggccaagccagaagcaaaagcctataagctcactgacggcgaaggcatggttttgcttgttcatcctaatggttccaaatattggcggctacgttatcgctttggcggtaaagaaaagatgctggcgctggggaagtaccctgaaatatcgttggcagatgccagagcacggcgtgacgaagctcgtaagcagttagctaatggtgtggacccaagtgagagcaagaaagccgttaaggtagagcaggagcaagaagcgataacttttgaagtggtagccagagagtggcatgccagtaatcgtcaatggtcagaagctcacagtgctcgagtactcaaaagcttagaggacaatctctttcaagccattggcaaacggaatatcgcagacctcggaacccgtgatcttttgcctccaattaaagccatagagatggctggacgtctttaggtggcttcccgcctgcaacaacgaaccacagcaataatgcgctatgcagttcaaagcggtttaattgattacaaccccgcgcaggagatggcgggcgctgttgctaccggtaaaagaaagcaccgtgctgcacttgagttaaaccgtgtttcagagttacttcaccgtatcgactactacagtggcaggccactcactcggctagcggtagaattgactttattggtctttatccgttccagtgaattacgctttgcccgttggtcagaagttgattttgaaaccgccatgtggaccatccctggagaacgagaaccattggaaggtgtgaagcattcacatcgaggttcaaaaatgcgcactccccatcttgtccccttatcccgccaggcgctcgccattctggaaaagatcaaaagcatgagcggaaaccgtgaactgatctttatcggtgatcatgacccacgtaaaccaatgagtgaaaacacggtaaacaaagccctacgcgtgatgggatatgacacgaaagttgaagtctgtggccacggtttcagaaccatggcttgtagttcattgattgagtcgggattatggtcgagagatgcggttgagcggcagatgagtcaccaggaacgtaactctgtgcgtgcggcttatattcataaggccgagcacttagatgaacgcagattgatgattcagtggtgggcggatttttctggaggcaaacaggcagcaagctatttcaccttttgattatgcaaaagtaaataatccattcaaataaccataactagccttttatcgtaatacatctcattcaatagttttttatatcactgaaagcctctgtcaaaagacaggggcttttgcgttttaatcaacctaaaaggaaatcatgatggaaaataacatttgttgtccggtagacgcagatctgaaagacagatttagccagatcgataccaatgacttttatcgagttcatgatgcagtacctctgaaaaaagaacactcagcataagtgtggcaggacttacgctgagggagggacgtccatcacatcaccaacaacatctctgtcacttaagaaatcatccgtttgtgccaaaataaactgctttaaaaactgatcaatacgtatattcaatttaaatggaggtatgattacgccgtcttgtttttcaaaatagatcttggctttcgctttatttaccgaatcttttaatgcgtcgaagcgaccaaaatcattgagatttttatcattaacactatcagccattaatgctatgagccgttctttatctaaaccaagagcattaacaacggcgtttaattgcgcattttcagcattatctttgtaggtgttgatatagtctctaaaagtatggccttcaattaactgcgcatcgccgcgctgcaagtcgtgcaagaagagcttggcgtacttttgctcgctttgggtgagcgatgcaaacgacttgtgtagctcatttaatgtggtttcaatgctcgcagggtcttggtgttggttcagctcttttaaaaatttatcaaagcggctgttcatatagtcggcatcgattttgccggtatctatttcagttaaataaccactgatatcaaaaggcacatcgccgccacctgcgccaccaccatcacctttggcgactaactctttgtaacgcagaaccaggctcaggtaagtttgttcgtctatagccagcgttacctcatgttctacatcattttcagtaggggaatagaccgactgttcccaatgcaaaccttgtactttagccgcttccaggtgttggctaaaggtgttaaataatttggcgaattgggcacaggtttctatatcgtctggcagtttttcaaagttctcaacacccgcactgacgaatagctcggtaatgtccgcgactaattcattcatggctttaaggttgctttctaacttgtcaacaaataagccgataggtctgtcgccggaatagagttttaccgcatcgttaatgtactgctccatggtgtgtggataacgataataacggatgatgccgtggggtttgtcggggccaaacaagcgattggtgcgcgagaacgcttgaataatattttggtatttaatcaccttgtctaaatacaaggtattgagccatttagagtcaaagccagtgagcatttgatccactacaatcagtatatctaattgcttcgaaggctcggtatggatgcgctcgtaaggctttttatgggcaagtcgtgccgctaaatcttttttaaaggccgcgtggcgggcaaaatcaaaatcctggccataacgcgcattatagtcggccataatttcgtccagagcatcgcctttaaaggtggggcctcggtcgccactgccgtcgttatcaatatttgggtcaaatagggccgatactttaagttcaggtttggcggcttttaaacggcggtaatagtcaatggcttcggcaatgctgttagtggccaaaatagcgtgaaatttattgccttggctgagcacatcccactcggccaaaatatcttctaccaccttttcttgatggtctgcagtgagatattgttcttttggcacataatcttctatgcctttgatatacttgcctgttgcatctttatggccagccattagcacatcattcataaaataattaaattttttctttttggcagccgtagacattgcatctgcaaccgaatcggccttagcctgttcaagggcgacggcctggcgtaaacctttatctttaaaggtacagattttgtaagggtcaaagcccaaaacattgccgtcgcgaataccgtcggcaatgctgtagcggtgtagctcgttgccaaacacatcagcggtagtattgctattaacttgattttcatcatgaatcggcgtgccggtaaaaccaaaaaagagtgccttggggaatgtttttttaattcttaccaacatgccttctttattttctttgcctccactcatcgtcgagcgatgggcctcatcgataataaacaccaagcgcttagcgcggattttttctatgtcggccgaatttgttgctgttccctcatcatcaacttcttcaaaaatattactcattttttgaatagagctaacaattaacgtatcggcagttgcactgctttttaatttagtaatgagtacatgagtattttcggtggcttgcacgtcttcgccatcgccagcaaaattgcggtattccgtgagcgactgggtgcccagttcaatcctgtccattaaaaaaatcactttatcggcatctttcgattgtgcaatcaactgcgccgatttaaagctggtcatggttttacccgaaccggtggtatgccacacataaccaccgaggcggtcagggttattggccgcgctacccagttgctgccagttggttttggccactttgtcagatatcgcattggcggcgtaatactgataactgcgcatcaccttaagcacgccgtcggtatcgtcggcgacggtataaaagccaatcaactggtgcgccatagggatagaaagcaaggtagaggcgatgtctttccagtggttcatgggttcgttattaaaatcggcccagttaaattgatagtcggggttaaacttaccgtctagcccggggttggcaaagtatttggcctcgtttggctccatggctacaaacacttggatgagcgaaaacaggccgctaaagacgccctctttgctgtacttttcaatttggttgactgcctggctaaccggagtgccgctgcgcttcagctctaaatggatcaccggcataccgttgatcagtaatagcacatcgccgcgtcggtcgttacgcaaggggctgccacgttcaaatttgggttgttgcacaatttggtaacggctttggccggctgcaatttcttggcgatcgtatatttttaagctgacttctttgcccatatgcaaagtatcggctgggttatcgcgcttaatggccacggttttgccgttaattaaaccattaagcttgagcggggttttaagttctttgatttgctcaataatttgctgcatttcagtcgcggttaacggcacatcgtttaaacggtcccgctggcgattattttcaaacaaaatggacgcccaattttgcagtaaatccgcttcggttttattgttgagtatctctgtttcccagcccttatgggtcagtacttcaataaaggcctgctcaaattgcgcttcggttttaaaggtggtcatgaacactccctatataaacatttttctcaagcaggcctgcttgatgttgttaagtttggtgatttgttgttggtgttggttgattaatgcgtcgagcttttggaaatatttgcctatttcgacttgttcttccgcactctttggaaacacaatatttgtattctgtattgcagtctttgatattgataatacttttgtaccctgcatcaatgacaaaagctgatcatggtatgaagatgaatttaaatagtatccaagatatttagaagcaaaattcaacgtaggcctaaccgcaatcgtgtgcaatccagaaagaactaactgctcacctatattaaatagctcggtgcattttccaaccatactatcttcagcagcatctgcaatgataatatcaccatcgcgcaaggcggcatgttttagtttattggttacgtcattatttgtaataaaaggcaaaagctcattagttgcatctagaacttcaccgaatttaattaatacatcgccatagtgaatattttttgccattccatcttcataattcagatcggctctagaaagagtattgttcgatacgttaacaaagcaagttccaaatggcatctcctcccatttcccactaaaccctttaaagcggatttctgggatggttttgcctggtttggggaacatcttttccagcatggcttttttaatgttgctgagtttgtcatgcttttgttggtgctggttgattaggctatcgagtttttggaagtagttgcctatttgggtttgttcttcgtcgtagcacgtatttatcggtgttgctttcgcttgttcaattgtgtaatgcgcaatcgttcctgtatgagaaatacttttaatgtgttttttgaaaggtgcgctaaagaaaaaggtatatagaaaatatccattgaactttttattgttctttagccaaagcaagtcagcatccttgaaatataaaggatcatcgttcggaactaggtaaggaataccaatcgagccaccgccagttataagtagatcatcttttgttaccttaccaattttctcagagagaccgttgtaaacctcgggggaaatataggatttagtgttttcctgtcctttgtaaatagatacaacatcgcttgttctaaaaaatggcacgcctgcttcagtccattgctctttatgaactcgcgcggcagatctaatatctattaattcacctagattattttcaacccacgccccactaaaccctttaaaccgaatttcaggcactttcttctcgacactcatcttattcgcccttcaataagcgggtaagctcattcaagccctgcatatcaaattcattacctgttagctcgctcatcatctgcgccagttcttgctcggtgttttttatctcattggccacttgcgagtaagtgacagcgtatttatcagcaagggcttgtacttggcgggttagctggttaatcacggcgtttggcatggcggcgagttcggtgcttaatggcgcaatccatttaaggtgcagcaggttgttcacttgttcatcagttaatgcttcgatagttgttttggtttttaagtgcagggcagtggcggcatctttgacggtttttttcagggttttttcttcatcgattaatttgttcgcgcgaatgattttggcttcatagctgtcttcggcaaatttagttttggcatctttttgctctttcaagaagactttggctgccttacttaattcggcattggcaaagccgtcttggctttctttgaccgtatcttgttctttttcttcttcggttagggattctaaaatttcttccagcgtactggcgatttcagccaggcgggtttcttttgcggccagagcttgtaagtcatcacttaagtaagtttgttgcactaaatcaaacggcagtatgtggcctttccagccgtcttgcacttcagtgtcctggccgttttttttctttataacaatattggcatcaacttgtttggcggcggcaaagccttcggtttgcatcatttctaaatcggcgctgatgagctgccattggttgtttagaaattggtaagcctggtatttgtcgatgagggcaatgggagctaagcgagtaaatagctcggtacttaataccgcctcttgttggttacgctttacgctgtgccagttttgtattaactgggtgtttaggtaatcatcaaagccattaaaggcttggttgtaggcgctgataaacgctaacacttgcggatgcccactaatactggcgttgacgttttgtttggcaatagccagctcactgtaagcggcggattttggcgtaaacagagtatcgtgcaattgcgggaaggcttgccaataattgtgtagctcggcaatttcgctgttggggatgccgccgagcatggtggcgtgtaaatcccagcttggtgtcgccgcagaggaatcgacatagcgcggtatgttgagattgtagccgttgtcgcgcagggtttgtttgctcaccagctgtgagaacttgtcgatactttcacgcttaatcactgcatcagtaatgcgtttgatatcactggcttgcagtttgttgtttttaccttctttcataaagtgtttggaggcatcaaccaccaatacatcggtgttttggcgtttttgcttgagtaccaaaatcactgtgggaatgccggtaccaaaaaagatattggccggtaaaccgataatagtatcaatgtgattctgctcaatgagttgcttgcgaatttgaccttcttcaccgccacggaacaagacaccatggggcagaacaatggccataatgccatcgggttttaggtggtagaggtcgtgcagcaaaaaagcaaaatcggctttggttttaggggccaggccaaaacgtgaatagcgtggatcgctgtctttaaagctggggtcccagttttgtgagtaaggcgggttggatactacggcatcgacgtgcaaggcgtaatatgatccttgaggatcgctatcatcaaaaaacggccaatcgtcttccagggtgtcgccattacgggttttaatgttgctggctttgataccgcgcatgatgaggttcatacgggttaggttgtaggtattggcttttaactcttgggcgtaataggtgatgctgtctttgtttttagcgtatttctcgaatgcctcaccgatattgatcagcaacgaacccgagccggaggtcgggtcgtaaattttgatggtatctttgtgttttaactcgtaggcaatgatgttcgacatgagtactgagacttcatgaggcgtgtaaaactcaccggcttttttacctgcattggcggcaaatttctcaagcaggtattcgtaaatgtagcccagtacgtcatacccttgattaccattcatggggatgcttttgatcaggtgcagtaagtcgctgatggctttggtgcgtttgcccgcactttcacccagtttgcttaaaccggtttctaaggtggtaaaaatgccttcaaacagttttttgtaagttggcgaaatcaaacggctaaaggctgagagcgcatcacgtacgttagattcatcaaagtcggatgtggaatcaacccaggtagaaaacagattatcgtaggcaataaagtagcccaggttgccttgcacgtatttaacggtgtcggcgtcttcttcattgagggctttgatatcttcgggcgtcataccctgtctggtgacaaactgcaccaactggtcgcttaggtacttgtagaagataaagccgagtatgtaatctttgtattcattggcttcaattttagaacgcatctggttggcggattcccagatttttgccgcaagctgctgtttattcactataagtcctgttaaaagcaattcttttttggaaagggctattttagggttttgattgtacgtctgataggcgcttcttgctagcgggggcacgttgatgaattcgggcgaggaaagtgtaatgatgtgatggacgcccctccttaacgtagccagtgtcatacttttactgaccgcattaatctgggagtaacatcacactattaccgtttaccggcggcgattattttaagatctgtgctgaagatcttgcagaattggaaactgaggccttcaccatcaataaacttacagcaataaaacgatgcaggtgttttaagtgaactgtgcgatcggtaatctttattcctgcgccatcttctctcttgcggcgcgtatgacgtctaacctggctggcatatcaggatgggaactcagccactcgggtataccagcccgagtttcggcctcctctggcgtggtggtttgttgcaacgcatggtaaatatcttccatggctaacaacgaacgcttttcgcgctgcatttcggctatcgcccaagaatctgcctcgctctctattgtgcgggaaaattgcatctcatgaataaaggcggccgattgcaacagcgtatcgccaatgccattgacgtccccggtcatccacataaaggtcaaggcgactaatgatgaacgtaccaccatctgcatcgagtggcggtgggcatgatgccccatctcatgcaacatcactgcagccagggcatcatcactggtcgtcagcttgatcaaatcgtcgctgatcaccattgtgccatcaggcaacataaaggcattggctgtcgtcggcgcggtcatcaataccagtttgagcggtgtgcgttcctgccgcatttgcgggggcattacctgcaaaaagagttgttggatcgcttcttgtcgttctgcgggcaacgctgaaggtttaaatccactttgctgtagccattcaagggagtgctcccccagtttctgttcagcagtggttgggatacgcagcgcaatttcactgctggcccaaggaagtagccaatagatgtaagccaagataagtaatggggtgatgagcaacgtcaacaagacaccgcttttatgacgctctaagcgatgcactaccccaggtgagcgctgttggtatagccacttacggaacaaagcgtcatcggagggaacaaagcgaccgccatcgggaaatgtcaggttcagtgggatagaacctaatgaagacgaaacgttgagctgcgacagggagaaatagtgctgttctccatcacgtagcaacgtcacgttatcgcctatttcattcagcagtagtcgggccgcctcgcgggcggcccgacctgggtactgataatatccttcaacgatcactgatagctactcaaacactgatagttactcaaacactgatagctactcaaaagccagtgcccagatcgagtgcttgtactgcttcttcggcgagggcgctattcgctgtgtcctgatgagcgtggatattcagtaaagacaagtcaccttcaatctcagttgcattagccatatagcgtgcatggcgtacttctgcaattggtgtggcaagccccaatgagcacacagtgatcaggctgttggtcattaacaggcccatataagacaggagtttcatggaagaacgtagcttgatgtcaccttgtaatgttgtttgactaaacaggtaattacgttgggcaacgatgcggtagctgctggaaaccatggtgccgagtagcaatatcagcatcatgaatagcaggttgctgaaattctgaattatcagcatagctgtcttattttcgttggcgatggaaccattcagggcagattggaacagatcggcaaaaaacgcacctgcgaacatcatagcaacaaaaaagaaggggataaaaatcaacacactgaaaaaggcgattttaataaatgctgatttttttaacgtactaataaaagatgaattaccaaaagagaggttattaacgtacaggctgtgttgcaacgtgctcacaatgccattgatcactgccagcagcgggaccagaagaatcgcagaaacaacaatgagtgttatagccgtagaaggggtgctggcaacagaacctagaaacatcgccatgacgatcataacggcatagagccccagaattaacagcagtgggcaaaacagtaacgcccaataagcctgtccagtctggcagtgataattaaaacgaacaccacgatagctggtcataatggcattgtagcgccagctacggataataatccatggaatcaatgccagcaacaccagtgcaaccaaaaggccaagtgttggggcaattgctaataatatatagaataaaatcacaccaccaataaccatcaagcgccctttaaggatctcgattggctctgcgtgataatcaaaacgatcaccgtttagctcagtattgccataaaagtaacggcgacgacgtacggtagcccaggcagaataaacacccagtgtaattatcgttagtaataaattcactaaccagatagagaaatactcgccaccttcgcctttgaaggccattctatgtagcgatttattttgtgaggcgttatctgccataaacctttcatcctataggtaatataatttgcctatatgttcctatttttattcacaataggtgttatggagatagacgatatccacataataatcacaaggcagtaaagtgccgcataataatctcaagtaaaatagatcgcaaatgatgttttattctatcttcattattttatttatatttatcaactaactttatgatttcatggaatatattaaatttagcacctaaatttatttttagggtaatttgtcatttatgacgacgaatggctccttttataataagataattcttgtattgatcgtgtaaaatcattatttacctccataggaataatgtgaaattcgtttttttgttattaaaaaatagccagtaagggtatcaattgtaatattacccgtgcaggccgcacgattattgattggattaagccatgcttaggtattctaatcgcagaggaagtacatcgctttctattaccaatgagcttactgactattaccaatgcgcttaccgactatcatcgcgtctatattatgatattgatgaacgaatgttaattaattgtagcaatatgtgctggatataacagttgcagtagagaaggggtgatctttgtcttcttttcggcgtaacatgcgtttgatagtagatcccgacagaggataacgtgtcggataaaatctttttaaggagaaaacatgccgattcctgagcgtttaacaccaggcaaagccactaaaaatcggacacagagactgcttaagttactcgacgagatatccagtacacttgaggataatggtgatcaagaaaacgatcgggtacgagagctcattttacaatggaatgaaattgcctgccgagaacatgatttccatgagtttagggattttcacgcctataccagcaaagatgactttattatttcagcccagagaaaagctaaatatatcgaagatttccaatatattgagtcaattgaactggtcaatgttatcgcacaagctgaaggtaccgaacccgatatacattatgcggtcgatcttttggataagaattttcctgatggcgatgcttcagatcttatattctggcctaactattggtttcaggatgaaaatatgctccacattgaactcactccagaagaaactgtgggctatcttatggctcgctcagggagaacgttgcaaggcgctccagagattgaattaagatacccctattataactaaaatgacgattaaacttatcagtcaactgacggctctggtatcagagccgaatagtattcaccatgtctattttgctaaaagcctacgcgccgcaccattgctggcacagcaggttaattttcctcgtatggagttaattatcgagggttcacaagccatgatatgggatcggctttatgatgattttcaccataaagatgaatacatcatgcaccgtggtgatattttatttattccctccgggggctggaatattccccaatgggaacaaccggtaataacgttaagtattttatttggcaagcagagcttaggttttagcctgctaagttgggatggggaaagtgttgttcacaaagaaatggagagtgtattacggcgagggccacgggttggggcctatattttgcaggctttaaacgaaatgtcgttaatgcaacgagagcaaaccactgttcaacttattgttagaagcctaattagccactgtatcgatttgcttaggaatcaggtaaaaacgccatctcgcagccaaacgctatttgaatcgataagagaatatattgagagaaattatagtgaaccactgacacgggaatcggttgcgcacgtttttcatatttcacctaactacctgtcgcatttatttcgcaacgtagggaatattggatttaatgagtcggtcaacagtgcccgattggaaaatgctaaaatattgcttaagttctatgaaatgaaaatcaaggaagttgcaaatgtctgtgggtttattgatagcaactatttttgtaggttattccgtaaagagactgagttgacaccatcagaatatcgccaacaatatcgcagtaatatgatggaaagagatgttatttaatgacaatgctgacggttttgggggaagaaatgacttttttggttgccgcgaggattttctcaggatgacataaaaaagtttgtatatcggcctgaacacaacggcaattctgaaagcgctcttgctctttaatcgcaacgtcgtttatcaatatcaccgcatctgcctgcaaaatatcgtcttcagtgagagagtactcaacacccaatgcaccttgtgtctcaacttttagttgccatttaagctgtaagcacagtttgtctaaccgctccgcgaccatgtaggtatgtgcgacgccactgacacaggccgttaccgcgaccagcttaattgtcatgccccctcctgatttgatcacctgtttcgtctccaaacaggcctgatttttttgcggcctcaacggtgttgatatcgctggcagcgcagggattaggtgtttttttccaaataggcggcaatcttgtccataatggcatcagcacgttttactgcgtcgctgacagcaatccgcacgatgactttgccagcaaaacgctcttcaaacaggatgccaatgtctttggtcagaatcaccatatccgccgcagccacgtcttccgctgtcagtttattttccaccccgatagacccctgtgtttcgactttgcactcccagccttttgctctagccgcccgttcgagcgcctcggcagccatgtaagtgtgggcaacgccagatgggcaagcggtgatagcaatgatgttggtcatggtgttttcctcccaatcccccccttcgtacttgaagccacaggggtgttagctgcgctcactcgcccgaatcacttaccggtcgttgaccttaaaataaataacgctcatcgggtgtaccgctaatttttaatatcgaaatccatgtccacatcgccctctgctgatgaccttcccggctgcttttgggcggtgaaacgctttaatagattggctatcaacgcggtaacgaccatgccgacgaacaaggccaccacaaagcccagtttaccgtcgaccaccggtagcacgatcaaccctccccaagcggcatagcactgggcaccgaacaacacggcagtcacggcggcgcaggcggaaccgatcatattggcaggaatgacacgcagtggatcggcggcggcaaacgggatagccccctcagtaatgccaacgcagcccatcagcatcgcggccttacctgcttcacgttcttccaccgagtaatatttacggccaatcagcgtggcaaggcccatgcccaacggcggggttgcaatggcgacggcggcgacggccaccaaggtataaacaccctgcgccacacagatcaacataaaggcataagccaccttgttgaccggcccgcccatgtcaaacgccagcatcaggcccataataattgccagtaatataacgcttccttgctgcataccctgtagccattgcgtgaggttggctgtcaggatgccgatgggttcacccaagccccacatcatgatcccagcggtgagaagggtaccgactatcgggatcacgaagatcggcatcaccgaacgcagcgtctttggcacggagatcttcttcagatagaaaacgataataccgcccagcaagcccgcgataatggcaccaaaaaaaccagccccgaaagaagcccctacccaagcaccgatagccgccggggcgagcgccgcacgatccgcaatggcgtaaccgatataggctgccaaaaatggcaccatcaacgtcaagcccacgacaccaatatcgaatagctttttcagattagggtcactggcaacctctggcaccgcacctttaccgtaaagcatcacagaaagtgctagcaaaataccgccagcaaccacaaaagggatcatatatgaaacgcccgtcatcagatgttggcgcgtgtttttaagtatatttatcagctctttcatcattcactccatagcgttcatccgtgtgcgatgagttccgcaggcgtcagggcttattccccttaatattgaaatcgcgaaatgtttttgatgctgttggataccacaataggcaagtcctcaccgcgctaacaggggacaaaattgccatttactggatttttgtaatgtcatcagaaaaatgagagccatctcaacttcccggcgattagtgagttcaactcattagatgaacactttgtgagcaatatcccaattatcgcttgtgattacatttgtccagtatttgacatttttatctcatagccgcgaggggatagccgcttttatgctggttaccagccagcgaggggaggaaagcccaatgaccaagcaagtgacatttatctgcgggcttcctaatggcgttcatgcccgacccgcgagccatatagaaagggtgtgcaaccgcttccagtcgcgtttccactggtataatccgcgttctggcatcgtgggggatggcaagagcgtactttcgctgatcgcgaccaatatcctgttaggggatgaatgtcaggtcaccattgaaggcgaagatgagcaggctgcttttgaacgcctgagtatttttattgagcacgagcttccacacgctgaccccatcttgcccaagagggaggagagtgcagaatgggagccgctccccgcctcgttagcccacttgcaccccaccctgttacgcgcccgttcagtcagtccaggtaccgcctgcgggaagttgctgtctctgataagagccgatctcaatgcattgggtgatttacccgtggcgcaaggtatcgagagggagcagcagatgcttgccgatggggtggcgcagctaggtaaagcgtgggagagcttattagtcgccaatagcagtacgacagaaaataacagtacgacagaaaataacagcacgacgcgagcgatacgggaagtacaccgctcgctgttgcgtgatggcacatttcgtcaacggctcttgagtcacatcgtagcaggtgaaagctgtgcgacagccatcgtcgctactgcggcctatttcagccagcagttggcgcttgctgctaacacttatctacgtgaacgtgagttggatattcgagacgtcagttttcaattgttacagcagatttatggtgagcaacgttttccctcccagcaagcattgagcgaagacagtctctgcattgccgatgagttaaccccgagccaattcctggcgctggataaacgttatctaaaagggttgctattgggccgtggtggcagtacttcacatacggtgattctggcgcgttcattcaatattccgacgctcgtgggtgtcgatgctacggcactccagccgtatctcaatcaatcgctgcagattgatggtgagcttgggctggtggtctgtcttttggatgagccggtgcgccgttactatcggcaggagcagtggctacacgaccaactgcgtgagcagcagagcagataccagaatatgcctgggcgtactcttgatggtgtcagaatggtggtggcggctaacatcacccatgcggtagaggtggagggtgctttcaatcaaggtgccgaatccatcggcttgtttcgtactgaaatgttgtatatggatcgcgcagccgcgccttcagaagaggagctttataccctttacgctcaggcccttggcgctgccaagggcaaaccgatgattattcgcaccatcgatattggcggtgataaaccggtgagttatctgaatattcctgcggagagcaacccgtttctgggctaccgcgcggtacgtatttatcacgagtttctgtcgctatttcatactcaattgcgggcgatcctgcgggcgtcaatgcatggcccgctcaaaatcatgatcccgatgatctcctcaatggaggagatcctgtgggtgaaagatcaactggcagaggtgaaacaatcactgcgtatcaatcatcttcagttcgacgaaactgtccccttgggtatgatgctggaagtgccttcagtgatgttcatcatcgatcaatgctgtgaggaaatggattttttgagtattggcagtaacgacctaacacagtacctgctggctgttgatcgcgataatgccaaggtgagtgagcactatcactgcttgtccccggcactcctacgcgctctcgattacgcagtgtgcgaagtacatcgccacggtaagtggattggcttatgtggtgaactggcggcaaaagactcggtattacctctgttggtagcgatggggctagatgagatcagcatgagtgcctcttttattggcgcgactaaagctcgccttgccaaacttgatcgcggcgagtgccgcctgctgctcaaccgggcgatggcttgccgcacatcacgggaagtagaacatctgctggtgcagtacgacggggaacaaggtgatgaaccactgattattcctgaatgtattactctcggtgtggattggcgtagcaaagaagaggtgatcaaagggatggtggataacctgctgctggctggacgttgccggtatccgcgcaaactggctgcggatgtgtgggcgcgagaagcccttttttccaccggattgggctttgggtttgccattccgcatgctcaatctgagcatattgagcagtcgacgattagcgtggccaagttggcacaaccggtgaattggggagaggaagacgcactgtttgtgatgatgttaaccctgaaaaaacaggcttcgggtgaccagcatatgcgtattttttccaaactggcgcgtcggatcatgcacgagggtttccgcgaggcgctggttagcgctgggacggcccagcaaatagaaacgctgctgaaacacgagctcgaactgtgattctttcatttcaacatgacgggtgccgcgtctgaggtggcacccagtgacccttatcggattacttcaataagaatgactttccttgcttaagcactaaatcgcaggctttggttttgattttttctgtgatttgcccggtaccgaggtcattcaggtttacgcttttgccttcactggttttcagcaacccgcccaagccctcttcataatccgtacttttcgccgcttctgtaccactgatacccagtttgctcatcagttggtctttaatcgccgtggtgccatcgcttgataacacattattctgtacgcaatattgcaaaataccggtggcattgttcatggtgcctgcacttaacgctttatctccgccattgagtaagttcgtcagtgatgacatcgacggcagtgacgatgagctaccggctgatttaccgtattgctccgcggtgctttttaccgaatccaataaactgttggcgtgagcagcaccggtcaccaacggggcagaaaaagccagtgctaagaataggcgatgaatgttatccatagaaactcctgttttatatggtggtcacagccaatatggcgtgagaccgtaagaatagcttacagatttcattttgcggtataggggttatctgataacgcgggtgaatggcagagaattaaaagagaggccgatagaagcatgattatcagcccctgggcgatgcatcttggtcagtagatctgattggcagggtgaatatctgttcaacaccttccgtaaagggcgctattttaaccgggccgcgacactattttaaccgggccgcgacacattggtatcgcggtccgcattgactaaagcattaagccaaggaatcaagctaaggcattaggccgataaataccgtttttttgcgtggccccgtcattaatggtgccaactgttcgacacactgtaagtaatgcggtgttgtcttatgaatggcgaccgcagcttcatcggtataggcttcgtaaatataaaagcgcgtcgggatatgctcgtcccttaacacatcaaaacgtaaattccccgcttcgcggatagacccaaggtgattggcgcgaaaaacctcaatgaactgatcaactttgtcctcttttacattaatttcgacgagagtaacgtgcatacttttctccttgtcatggggccattagcggtaggtaaaatcacggatggccgccagttctactcaattttgttcatggaggaacagttggtaagccgcagcggcattctcatttttatgcacaatggcatgtaccgctttcagcatggcgatcggcgcatctgactgaaaaatattgcgccccatatccacgcctgatgccccttgatcaatcgcttgatagcacatttccagcgcatcacgttccggcaactttttcccacctgcaatcacaatcggtaccgggcaaccggcggcaatgcgctcaaacccgctatcgacataatacgttttgatcacctgcgcgcccatttctgccgcgattcggctggctagcgagaagtaacgttgatctcgcaccatatctttacccacgcccgtcaccgccatggttggcatgccatagcgcatcccttgatcgatcaattggataatatttttaatcgattgatgttcatgttccgtaccgatatacacctgtgcggcgaccgcgcaggcattgagccgtacagcatcttccatcgctacggcgaccgcttcattggataaatcggtcagaattgagttagcaccggaggcgcgcagtaccaccgggcggttggccgccgctggaacgacgctacgcaaaataccgcgggtacacattaagacatcggcatactcaaacagcggggcgatattgatatcaattcgctccagcccggtggtcggcccctgaaaatagccatggtcaaaggccagcatcaccgtgcgattggttttcgggttaaaaatccgcgccaggcgggattgcattccccaatcgagtgaacctgaacctttcagcgtaaacgcggggttctgctgtgggatgccaataccgaaatctttaccgtctttgatatcgtctaaatcagccatctttaattactccattcgttctgttcaggcccaccacgggggcgggccgctaagattaaaagtcgtatttactgatattttctttggtgaagatgacgcgctgtggcagtaaaacgataccgttgcctttcgcctcatagtcgtagccctgcacacggttaggggagacctcaaccacaccaatattcgggatatcaatcttatcccctacattcagatcgccttttttcagcatctcattggcgacatacactgagattttgccttggttcaccacatcccagaggccgaactctttgaccgtgccacgctcgacataggggcgcatcacgttcggggtactgaagccgacgatggcaacattagcgcgcttcaggttttcggcggcttgtgcggccgcaggtagggcgttagcgtccggagcaataatcgcatccaaatcgccataggcttttaaaataccctcggcggtttgcagggattttgtggcatcgttataaccaaactgggtggtgacgatttcccagccgggatgctcttgttgaatctttttcttcgcctcattgacccactggttctgatcggtcaccgtcgggctggaatagaagaacgccactttggcttgctcttttttcacctgattggcggccatatccaccaacattgatcccaattgatttggcgtaccttggttgatatacaccgaacgacactctggtttggtatcggagtcccaggttaggattttgacgccccgttgcatggcgcgcttcaaggctgggcacaggccatccggtgataccgcagacaccacgatggcgttatagccctgattaacaaagttattgatcaattggacctggccggaaacgctcggttcggtcgggccgtcataggtgacatccacccccaatgctttacctgcatcgacggcacctttaccgccactggtgaagaaaccgaccccgaccagtttcgggataaatgcgatgcgttccgcagcttgtgcggtagtgatacaggcaaatccaagagcgcaaaccagtgctaatttttttaatctttgtgttctcattgctatctccgaatcactgtcttgttgggtgttgggtttaggtatcacgccgaggcctttcgactgcgacgacgttgtagccattcataaatcaaatgcctgtgcagactgatcgatcgcccaaccaccaccagaatcagcaatgccccagacagcgcactggaaatttggtttggcgtaccaatcatttgcagaccttgttgcaggtacccgaccagtaataccgccaaggcagttccaagaatggagccggatcccccgtaaatattggcccctcccaataccacggcggtgatcgccggcatcaggaatgaggcacctaaatcagagcgtgcggagccgaaataagacaccagcagaatggcggcaatcgctgaggccaccccggtcatggcatacagcatgcataaggtgcgggcgatgggcagggcgctgtaacgggcgactcggctgctttgcccaatcaggaacacgtggcggccactgtgagtacggtgcatcagcagccagaacagcagcacacacagcataaatatcaccagggggattggcagcccgaagagggtttggttggcgaaatcagtaaaagcggccgggaaaccgccaatcccttcatagcctgtcgcaccggagaggccggataacagcagggcactgccaccgaacagatacagggtgccgagcgtgatgaccaaggggttgacgccggtatagaggatcaatccggcattaattaacccacacagtgcgccgacgagcactgtcagtgggatagccacactcatcggcacgcccgcctgaaatacaatgcccagaaatatggcgcacaacccgatagtcgaaccgaatgaaatatcgatgccgccactgacaatcaccatggtcaatggcagcgccacgatcccgatgcagataaaatcactggtgctgaacagcagcacattgatatccaacatgcgcgaattcgataaaccaaatagcaggatttccagcaccagcagcgccgccagagtcagttcccatccataacgtcggtagagattcatagtgccgccttctttttattgctagctgctgggttgttatcgctaacggttggttttttatcactaataatggcttgggcagtgaagcgggcatatttctgttggcggatattacgctcaacagcacaacgcagacggccatcgaataccaacacccccagcagcaccaaaccggcaataaagtcattccaccaggccggtaggcgcagtaacaccagtacgctatcgatttgtgtcagcaggaaagcgcccaaaatggcaccaataatggtccccgtcccaccaagcaggctgatcccgcccaacacgcaggcggcaatggccttcatttccagcccgttgcctgtttggttagggataaagccaatttgggaagcgaagacgatcccagccagtgcggccatcacgccgttcattgagaaggcaaaaatgcggatactgtcggtacggacccccaactgacgcgccccttgtaagttatcccccgtggcatagaaactgcggccaaaggcggtgttgcccaacagccaggccatagaaaggatcagcaacatcgttagccagccaatgggcgagatagaaaacagaatgggggttgataaacttttcaggtccgccggtaatccttcgatccacttaccgcctgttagcagtagcattaggccacggtataacccaagcgtacccagcgtggcgacaatggccggaatgcgcagccaggtcactaaaatgccgttaaaaaagcccgctaccatgccgaccaacaaggcgaacaagcaagatgccaccaggccaaaaccggcattcagcgccataccgacggtcaccgcgcataaaccggtgatggagcccacggaaacgtcgatattgcgggtcaacatcaccagggtggccccgatggccagcaggatcaggatctgtgcgctgctgaaaatcatggtgaaggtctgcaagctgaaatagttgcggtcaataatccccaatagggcaaatagggtgagaatggccagtagcgcggtaccttcacgattattctgaataaatttcagcatgatgtgcccttattttcagccgaggaggcggtgccgctctgaggttcactcacagaacggtgctcaccaaacgccatatgcatgatggtatcgacattcattgccgcaccgctcagtgcgccattgatttccccttggtgcatcaccaatacccggtcggccatttgtactacctcttccagatcggaagagataaaaatgatcgcgacctgctgctcggcaatgctacggattaattggtagatatcgctacgggcagagacatccaccccacgggtcggttcatcgataatcagtaggagtggattggcttccagacatttggcaatcagcagtttttgctggttaccgccagataaggtacggaccggttgttcgaggtggctgaatttaatgttcagcgcccgacggtaacgctccaacacggccgcctcctgcgctggttgggtccataaaccttgtcggtcatgggccagcgcacagacattccagcttaatggcgcatcaagatagaggccggatgcttgccgatcctccggcaaatacactaagcccgccgccaggcgattggcggttttcatcgccgtgatattgacctcttccagtatcacgttaccggtgctggcaggccgcaagccatacagtgtttcagccagttctgttctccccgcaccaacgacacccgccagcccaaggatttcaccggcttgcacatgaaaggaaatatgcgcgaaaccttcgccactcaagtcgtgcacgtgtatcaccggttgttgtgattgagcacgtgattgggcgcggcggttaccgggcagttccaaccataatttctggctatcggttaatgcccctttttgggcctctggggtcatggcctgaatcatgtcttctgtagaaaaatcggcggttgatccactcaaggcaataccgccatcgcgcatcacactgacccaatctgccagttggcgtatttcaggcaatttgtgggagataaacaccaccccaacgccttgctgcaataacattctgatttggctgaataaacggtgggtttcagcaggggttaacgaggccgtgggttcatcaaggatcaaaatgcgcgagtcacgcatcaggccgcgcataatctccaccaattgttgatcggccacctccagtgaaccggcactgaccgacaaatccaaatggcaacccaagtttttcagcaattgggccatcttctttttatcggcttgatgcttgggtaagcggaacagaatattttcctgcaccgacagattggcgaagagcatcggttcctgtggtaccagataaatacctaattgatgtgctttcgccggggtgaggttgaaacagggctgcccattcatttcaatcacgccagtatccgggggcagtatcccggcaatgatcttcatcaacgtggatttacccgcgccatttccccccaacagggcatggacctgaccgggttgcagagtaaagtcgatacttttcaagaccactacgccggaaaattgtttactgataccacgtacttggagcaggggcggcggtgtagcaacggtatgcggcatcagtagctcctggtggcttaattgaaaagttttagtgaacaaaaatatttttaatttaaaagtgttcaaaaaagatagctgtataatccgatgtatggcgtaaccaagatcacaatttaatgaataaaaaaattttaattaaaatatgttcaattatgatcattaagctgatagcgtggttatcaattaagattaaacattcattacgcagtggctttagtcggtggcgaaccgatggacagtgagaaaaaagataagcaggcaagaaagataaacagataagaaagataaacagataagaaagatcaaccggcaagaaagcggcaataagagaacaatcggcaatgataaaagaaaaaccagcagtaaaagaaaaaccagcagtaaaagaaaaacccctgtcgtccaacgacgaatacaaatatccgggtaatagcatgagtgaagaggaactgctcgctcgcgttgcgtggttttattatcacgatggtttaacacaaggggatattggtgagttgctggggctggctcggcttaaagtctctcgattattggagaaaggccggcagtctggggtgatccgcgtccagattaattcgcgctatgaaggctgtctggaactggaaaataccctgcaacagcattttggcctgaagcatatccgcattctgccgtctttggcctccctcagtatcagtagccggttgggtattggtgccgcccatttattaatggcgctgatacagccacaacaacttttggccgttggtttcggtgagaccaccatgtgcgccttgcaacatttgagtggctttatcgcatcacaacaggtccgtttagtcacgttatccggcggtgtcggctcctatatgacggggattggtcagttggatgcggcctgccaggtcagtatcattccggccccgctgcgtgcctcaaatgcccatgttgccgacacgtttcgccaggaaaacagcgtccgagatgtgatgctagccgcctgcgcggcagatattgcggtcgttgggatcggttcggttaatcagcaaaaagaagccacaattttgcgttcgggctatatcagcgaaggtgagcaactgatgtttagccgtaaaggcgcggttggggatatcctcggttactttatccaagccgatggcgcgttggtgccagatatgcagattcatcaggagttgattggtatttcgttggctgatttaaccaccatcccaaccgtgattggtgtcgcagggggggtagaaaaagcggatgtgattgtcgcagcgctgcgggggaggtatgtgaatgcgttggtgacggatgaggtgacggcgcgtgcaatcattaacttactttaattgggtgattggctatttcacttgccagtttgagattgggcagtgctcgtgaccgtcacagactgtgtgtaggctccgatctctgcgcgcggtcccacaggcaacttgaaatatgacgggtaaacactgcggtgacgccaaataagcagggtattcaagaggagcgcgcaatgagtcaactcgatacgactaccccatcaggtgattacttgatggcgctggatgccggtaccggcagtgtccgggcggtgatatttgatcttaatggtaatcagattgccgccgggcaggcggagtggctgcatctgccggtacccgatgttccggggtcgatggagtttgatttaaccaccaattggcaactcacgtgccagtgtatccgccaggcactgcatttggctaagttaccggccagtgctatccgtgctgtcgctgcctgttcaatgcgtgaagggatcgtactctatgatcgcagtggaaccccgatctgggcctgtgccaatgtggatgctcgcgccagccgtgaagtcagcgaattaaaagagctgcacaataatggatttgagttagaagtctatcaatgctccggccagacgctggcactgagtgccatgccccggttgttgtggttggcgcactatcggcccgatatttatcgtcaggcaggaacactgaccatgatcagtgactggctggccaatatgctcagtggggagctggcggtcgatccctccaacgcggggaccacgggtatgctggatctcgtcacccgtaactggcaaccgaacttgctggaaatggccgggttacgtgcggatattctctcgccagtgaaagagacaggcaccttgttgggccatgtcacggcgaaggccgcgcaagaatgtggtttgctggccggaacgccggtggtgatgggcggtggcgatgtacaactgggttgtttggggttgggagtggtgcacgcaggtcagacggcggtattgggcggtactttctggcagcaggtggttaatttaccgcagccgattattgatcccaatatgaatacccgaataaaccctcatgttatccccggtatggttcaggcggagtccatcagcttctttactggtctgacaatgcgctggttccgtgatgcgttttgcgccgaagaaaaattactggcgcagcgattggggattgatacctacagtttattggaggatatggccgccagggtccccgccggtgcttatggggtcatgcctatcttctctgatgtgatgcgttttaaatcttggtatcacgccgcgccttcatttattaacctctcactcgatcctgaaaaatgtaataaagccacgttattccgtgcgttggaagagaatgcggccatcgtctcggcctgtaatttagcgcaaattgctgaattctctggcgtgaaagcctcgtcggtggtttttgctggcggtggcgcgaaaggcaaactgtggagccagattctggctgatgtcaccggtgttccggtgaaggtgccggtggtcaaagaagcaaccgcattaggctgcgcgattgccgccggtgttggtgtcggcctatatgaagcattggataaaaccggcgagcggctcgtgcgctgggagcgggaatacatcccgaatactgagcataaagcgctctatcaagcggcaaaaactaactggcaagcggtgtataccgatcaactggggctggtggattgtgggttgacgacgtctctttggaaggctcctggcctctaaaatggattatcttcattaattgactatcttcattcattaactattttgattaattaactagcttgattaattaatagcgaaaagcggccagcttgcgcttcggggcaatgctcgccgccgtcacgtgctgcgtgtatgctccgttgactgtgcgctggtgacccactcactgagcgggtcaataaccttattgatcgcctgttttatttattccgccgggaggcttctatcaatgacttttaacatattcatatgctaaaacgattgccatgctgcaaacccctgatatagcataattgccctctttcgttgccaatgatggcgcatcctctgatggcgcatcccatgataaatacatcaaataagacagcatcacctgccgggcaactttctgctcccgcttctcaaaccggtgccagccacttgccggaagtactgcggaataaagagcatgttgcgcgcattttagtgattaaattacggcatttcggcgatgttctactgacgacgccgctactgagtacgctgaaagccaattatccgcaggctaaaatcgatgtactgctgtatggcggtacgcaggatatgttgcgtgaaaacaaggcgatcaatcatgcctttattgttgatcggggcctgaagcatgcaggattaaaggcgcaaatcagtggcgaaaaagcactgtttagcgccctaaaaaaacaacattatgatttgattcttaatttatccgatcaatggcgggctgcggcgtattgccgtttgttaaaacccacgtttagtatcggtttccactacccaaaacgggacaattggctctggcgttactgccattccacattggttgagatccctaatgctgcagaacggcacacggtactcaataatctggatattctctcaccactacaactgaccgacatcaggaccgacgtcaccatgtcctatgggccgcatgatatcgagcgggcaaagcagttgtgccaacagcataatattgaacactatattttgattcagccttccgcccgctggaaattcaaaacctgggccagcgaatccttcagtgaattgatcaaccacctcactcaacaaggtgaaactgttctgctgacgggcagtaaagatcaggctgaattggattacatcgctgagattattgctggctgcacacaaccggaaaaggtgatcaatttatcgggtcaattggcattgcctgaactggcggtcttaattgataacgccaaattatttattggtgttgattctgtggcaatgcatatggctgctgcgttacagacgccagcagtggtactatttggcccgagtaatcttaatcaatggcacccgtggcaggctccacatactttactctgggctggcaattaccgcactttgccgcatcccaatgaaatagatactgacactactgatcgctatctgaacgcaatcccagttagtgatgtcatagacgcagttgattcctggcgagttgccaaagggaattagtgggtcagtcgctttatttttcctaaccagctcgagctgagaaaattatgacaactttatcaccggcaattccggtcaatcgccgtagtgaaatgctgtgcagcatagcagcgttactcttaggtattagtatgccaacgaataatcagctaatgagtgtttcattggttttgattattatcagtttgatcattaaccgaaaatcccttgattttaaaccgttgctcaccagtccattagtctatctaccggcagctatgtttgtgttactggcgttatcattgttgtatcaaaacaacagctatggcccggatatggtaggaaaatataagaaacttctttatatcttgccattggccctgttctttatgaaccagccacggttgatcaaactgttctgtaccggctttctcgtcgctaacgctgtcatattggccggatctctggccgtgggtgttttacacattccgttgagtggtgtggaccccactaacccgaccatttttaaactgcaaattacccaaaacttctttatggcgctggcggcgttactctggctggtactggcgtttcaacatcaggggtggaaacgttggggttacagtgtgttagtggtggccgcaagttacagcatcttattcttggtattgggccgcaccggttatgttgccttgatagtgggtttaggggtatggctatttttctctctgggcaatcgccagcggttaacactggtcgtgctaggtgcattggcctttgctgccctgatctttatcccgaacaaagccacagatcgtatcgtacagggcgttgatgagataaaagtgtgtatggccgcatcggcaactgatgccgcagacgcatgtaattcctccatggggcagcgttctgcttttgtggttgaagctgcccggttaattaaagaatcacctattcttggtcatggcgcgggtggtttttattatgaaaataaagaagtggactacaaagtcaataacccgcacaaccagtatctactggaaacgattcaatcaggtgtgattggtctattcctctttttggcgtgggttatctgctgttatcgtgttatttggcagcaaacaccggctctgcgcaatgtgctgctggcggtattgaccagttatatggcatgtaacttcttcaattcatttctgctggattcgtctgaaggccacctgtttatgatttttgtggcggttctggcgggctattcggtgagcggttctggcagactgcaggtagcaaaaacctaatatattcaacggttatctctatgatataacggtaccatttggtgccgttttttatattcgtcctactgtgctttggctgcctacccatgcctaaaattattttttttatattattatccatataattaatttgttttataattttattttcatgaaaacttataataaaaaaatgaaaataaaaaaacacatgctataattccattaattaacttctgatttaaattaatttaatttttatagtgttgggttgtatctttaatataaattataagcttactaatattttttaaaatattataattgctattaattagaatatttattttcatgagtgttttggtttttttatgctgaggtattttatgattaggactaaaataaatagtggtggattggatgtggattttattcgcgatcaatttccgattctaaaaaaacaaataaatggtcacccactcgtttatttagataatgcatccacttgtcaaaaacctcaggcagtaatcgatgcaataacaaaatgttattgcgagtattatgccaatgcacatcggggagtacatacgctctcacagtgtgcaaccacggcttttgaacatgtgagagagcaagttcgtgattttcttcatgcccgatctacagatgaagttattttcactcgaggaacgacagaagctattaatttagtcgcgacaagctgggggaagagctatttgcatgagggtgatgaagtccttatttcggctcttgaacatcatagtaatcttgttccctggcagcaaatatgtagggttacgggggctcggcttaaagttttgcctatcgaaccatcaggggtattacagatagattcacttgagcatctactgagtaaccgaacgcgggttttagccctttctcatgtatctaatgtgctgggtacaatcaatccattagccgctatcattcaaaaggtgaggatatatgatcaaatgcagcaaggtaaaaaagaaaaaactattgtattgatcgatggcgcgcaggctgtaccacatatttccattaatgtgcaggagttagatgcagatttttacgccttttctgggcataagctctatggtccgagcggaattggtgtgttgtatggtcgtaatgacattctgcggaaaatgctcccttggcaatacggaggtggtatggtggcagatgttagctttgagcagtcgacttttgtggttcctccacgctgctttgaggcaggtactgcaaatattgctggcgttattgggctgggagccgcaattacatggttacaaaatctgggtattggtgtcatcgccgagcatgaacaaatactattaaaatatgtaaccgatcaactctcacaattctcgtgtattcgcatattaggtcaggtaccactaaaagctgctgtagtagcttttattattaaagatattccggccagaaatattggattagcattagataagcaaggtattgcggtacaggtcgggcggcattgtgctcaaccattaatgaatttctttgggctacaagaaacagtccgagtttcttttgcggtttataacacattagaagaaattgatgtctttatatccgcgttacatgaaataattaatcaacattaattatttcatcgacgaataaattactggttacagtaagaggtattatatgaatattgactggacgggtgcaactgatattaaagcgcaatatggatgtttgattgaagaggaaataaataaggaaacacaatatcgagaccataattctatacctattcctaatgagattatgcggaaatttgcaaacttaggtttgtttacatatatgctaccgaaaaaatttggtggtaaagaggttggggatgctatttggggcagggttctggaagatataggttatttatccagtgacacctcttttccttttcttatatcgctaaggatgtcttttatatcggcattaattgtgacggagaaaaaatactttattgaagaatacgttagtcaattagtttcgggaagtaaatttggtgcttttgcatatactgaaaatgctgacgctttttctttcacttctaatgcagtacgtcagtctaatggctcgggttatatccttaatggtataaaacaatttatcactggtggtgcgacagcggatcttttttttgtttttgttcgtagtgaaagtagtgatctgcaggtctttttggttcagcgttgtgatcccggtgtcgaagttattccgcgtgttatgcatggtgtccattcacttgggatagcacaactgaatctcaacaatgtaaaacttgataaaaatcgcttattggttgccagtgatggcctcagttttgtgcaacgttattttctcaattgccgtcgcgcattattaaccactttatttttaggacgagcgagggcaattattgaagagactattcattacttacaaagaaccattcgctatgatgaactgttggcggaaatgcaacatgttcaggccgctatcgggcgtatgactatcgcacttgaaaccgcacgggctatggtttaccactcactagaacggcaggcaagaaaagagagcgatccctactgggatcctatctcttcagcggcaaagcattatgcgattgaacaaataaatatgattgtacttaccgcgctaaaactaacggggggctggggctataccgaagatagcggtttaggtcgctcacatcgagatttttcttcaatgttggcgggtgctgatccacaagaaaaattagaggtcgatttgggtattcggattattcatgatcttcaaatgttgaaacaacaaaaagaagcactggaggacagataaaatgaaatttaaattatcaggtaacttagccaagtttactaattataaaaaagaactacatattgatattgagagttctagtacccttaaaaaattgattgataatttaattgaacaatatccagcattaaaagaggtgatttatgataaagaactaaaagttaagaaaggttatttattttcttttaatggtcaaaaaattaatccaaatgagtttaatgaacccataaaaaataatgattgtattgatattttcacggcgatagcaggaggatgatatgagtgaagaacggactgttaatacgatttacccgattcatacttgtttatttactgccttgcaattccatgggcgtgaactgttatctttgggtatgagcaataaatggttatggtttgaaaatcattttaatatgtcattccctgaatttattaaaaaatatcaacaaagtaatgttgctgttgctttcgaaattgaatatatccaaccatttgatttttttgatgctaagacttttgatgtgagtatttccaaagttaggttgagacaaaaagattcagtgtttgaatttcatcatgagtttactgccaataacattatttttgccagagtggctctgtactggcgtatattaatgttatcaggagatgacgcattaactgcacatcccggtccattaggaaaagaactgatccagctttttttacctgaggaaatcgatccgtctaggactgttcgtgcagtatctaaacagctctgtgaaattgaagccgaaggccagcttattacagagaattactctaattttacgctttttcgtcatcagtgtgaggttgcggatcaatggagttttgttgagttgccgacgttggcctccgctgggcgcgaacaactgattatttcgttagaagatgatccagagaacctgagtagtaccatggggatacccatcaagaatattgtggcgaaactaagttgcccgttttttctctttgatgaagggagagtcagaactcgtgcttacttactgaataatcaacccgtttttgtccatcatattttcaatatcagcagggctgatactctggctgctgtcgtcgtcgaaagtttttaatttaattactgcgtctggggagaataaataatatgagtaaattagctaatgacattgaatttataagccttagtccggcggaaatagggttatattcaaggcacttactgataccctccattggcgttaaaggccaattggcgctaaaaaatgctagtgtattgatggtaggggcaggtggtctcggttgccccgttttgctttatttagcagcagcgggtgttgggcggataggtattattgatgcagaccatattgaaatttctaatgtgcaccgacagatattatatcgggtagtagataaagggaagaataaagccgatgtagctaaatttcgtttacaggcacttaacccctatattgaaatagaaacctatattgatcgattaaatgtagataatgccgaagcactcatatctcgctacgatattgtggttgatgggacagataactttacaactaaatatcttattaatgatgcgtgttattttgccggtaagcctttggtgtatggtgccattatgcaatttgagggacaagtcgcagtatttaatgcattggatgagcagggggggtatggggctaattatcgtgacctttatagcgatcctcctgatgccgcattagcacctaattgtgctgaggctggagtgctgggtattttacctggcatcatcggctgttttcaggctaatgaggtaattaaattgattaccggactcggacggtctttgtctgaacgtctgctaatttatgatgcattggatgccacgacgacagaattacatttttctgcgtgtgcagataatccgctacgcgatcctaatcggcctcacgtattggaagaaataccggccatatgcaatagccctgtggtttctgatcaatttgttatcagcctcgatgaatttaatgatcttatgcgtgatcatgttgttatccatctaattgatgttcgtgaaccacatgagcgaaagcaagtctctattggtggcatacatattccgctagcagagatagacggcgttgaacatgaatacattaatgatgtgcctattattttatattgtcagtctggcgtccgtagccaaaaagccgccaaaattttggcagataaattacagcatgcacaaatattcagtcttaaggggggaatatctgcatttttggcttctaatttatatccagaactgatagccaatttagccttatgtcagtgtatacccaataaacctcaagatgcagatttgagcacctgaaaattaccgttaattctaaataactgagtcttttactgctacacctgtcctttttgagcatatgattgcacagtaaaagctgtgtgctacaagcttaataccatggcatttgacggtaaaactgagccaatcctttgtctagcaaaggataacgaaaatggagcactattaagtacagttatttaggtgatagggaatctactattttagtaagcgttgtgctgaaagaaccgtatatcgcttcgtgaaaatcatccgttttttcaatatatcggttattccgtgtatgttcgttcatcactttccacaatcgctctatcgcattcagatttgggctgtaaggcggcagctcatgtggtttgatgttggtgacgaatgcccagtccttaaccaaattcgattttttgcgcttcggcaataaatattttcatggtggaaagcatgatttccatgagatgtagcatcaagcatcttcattgatcacgggtataatgggttatggtatcctcactctttcttgcattagcaatagtcttaaatgaggctatgatacagtatacatttatattggtaagtcagtcagggatgtccctctcaactacgtagagaaggagggatgtgattgatcttgtcagcagtgagtgaggctgtgggcgtaggggcgatcactgtatgactggtccagttacccgcgacgctgtggattattgatttttattaggatgaactgcagttaaaaatgattcttattaagtaatcaaaatcacccttaaaaaatagccgatagtgaagagcgacgttaatgctatctttctatcggttatttgtctttatagggatattatttttttatttggtaatatagcagtattaatggcgtttatttacagagatcgcttgatatgccccaattaattgggtctatcagacagcaatgccaagggtttttgggatggcagttacagcgcaaacgctttagtctgtgtgtttctaatgcataatatatttattggtattgactctatagttgcttgggtatcaatctatcaatttgaattttatacatttttaggtgagaggttttggcgcgtcgtttttagtgtcgcaatgtgatgcactgagataaaaaggatgactgagtgaaatatatttatggagtgtgcttcttactgatagtcacgttgaccacgctttttgcatttcaaaatagcggtactgtgaatttatcattactctttacacaaataacgctacccatgtcagtgttaattgtgatgatctattttctagggatgtttaccggggggttattaatcacactgttaagggcactgatgcgcaatatgacgcaaaaaacagataaaaaagtgtgaatagataatctgcataagaattttaaaaacctgactcaacgagatcttacagtgaagataaaaacagtagtcactctgctcattacgttccttctcgccgcctgcgacagaacacctcctgaaaccgtcgaaagtgtgcgcccagtaaaaatctttatggtggaagacagcgggcaaaatggtacccgttatttcccggccaggctgcaagcgggtgatgaaacccaactctcctttaaacggggcgggcaactgcaagagttgttggtccgtgaaggggaacaggtgaagaaagggcaaaaaattgccatgttgaacgatactgatttgagtttaagagtcagggatcgtcaatcaaccttcaatctggcccgcgatcagtttaatcgctttaacaccttgcaaggccgcagcgccgtctcgcgtgccgatctggatattcgccgtgcagagatggagtcagcgcaagcggctttagacattgcgcgtaaagagctcagcgatgcgacaattatcgcacctttcgatggcatcattgccaatgtgaatgtacgtaatcaccaagttatggccgctggtcagccggttgccaccttgagtgcgctggatacgttggatgtggtattcagtgttccagagcgtctgtttaccacgctggacatcagcaaccgtaactacaagccaacggtattactgaaccatatgccagggcgtgagtttattgctgaatataaagaacacaccacttcgacgacctctgcttcacagactttccaggtcacgctgacgatgaaacgcccagcagatatgccattgctttccggtatcagtggccgggtcagaattaactccggcaatttgtctggcaccgaccatccaaccatcatcgttccggtggaagccgtatttaaccccgaccatgcgcagttgaatgatgcccgagtgtgggtcattaagaatgataatgaccaaatgcacgtagaagaacgcaaagtgcaggtggggcaactcgtggaaaacggtattcaagtgacctctggcctggctgatggcgaacaaattgttgccgcaggtaccggtgagcttcgcccacaacaagttgtccgggcttgggttcgtgagcgaggtctctaatgaagctgactgataattttatcaataataatacccgtatctggctaacgattctgttgctaggtattggtggcattattgcctatctcaatataggcaggctggaagacccggcttttaccatcaaaaccgcggtcgttgtcacccgctatgatggcgcatcggcacaacaggttgaagaagaagtcacgctaccgttggagaatgctattcaggaactctcctatgtggatgacgtaacctccatttccagtgccggtttatcgcagataaccattaatattcgtgcgcaatacggcgcgaatgagttaccgcaaatctgggatgagctgcggcgtaaaattagcgataacagtgttcgcctaccaccaggggccagtgcccccatggtcaacgatgattttggcgatgtttacggtttcttcttctcactgaccggtgacggctacagtaatcaggatctgcgtaattttgccgagcaattgcggcgtgaattagtgttggtgcccggtgtgggtaaagtcggcatcgtgggtattttaccggaagaagttcaggtagaaatttcccgtgcgcagatgacggccgcgggtattacaccgcagcagctatccgacttgctgagtcgccaaaacgtcgtgtccgatgcaggccagttgcaggtgggcagtgagtcgattcgcttgcacccgactggcgaattccaaagcgtacaagagctggggaatttactggtcagccaacccggtagcccaaaaagtgtctatctgcgcgatattgccacggtaacccaaggctttggtcattcaccgaccaatatttatcgcgcgaacggtcaaccggcattggcgttagggatctcgtttgctcccaatgttaacgtggtaaatgttgggaatgcgattaaatcccgtctggcgcagcttgaaggtgagcgcccgtccgggatgcatatcaatgtgttctacgatcagtctaaggaagttgaaggtgcggttaacggcttcattcttaacttcctgctggcactgttgattgttgtcgttaccctgctgatctttatgggggtacgcagcggcgtggttattgccatctcgctggcacttaacgtgctcggaacgttgctcatcatgtggctgtttaacatcgagctacagcgggtatcgttaggggcgctgatcattgcgctgagtatgctggtggataacgccatcgtggtggtggaaggggtggtcgttgggcgtcagcgcggcgatagcatttctactgctatcggtaatgtggtgaaacgctcgaagatgccgttgctgggtgcgaccattattgccattttggcctttgcgcctatcggcctgtccaatgatgctaccggcgaatattgtaagtcgctattccaggtgttgctcatctcgttaatgttgagctggatcactgcgttaacgttaacaccggtgtttgccaagtgggcattccagaaccaaaaacagcctgaagctgatgcggataagccggttaaacaaccgtatgacggctggttattccgctattatcgggtggtgttgaataaattactgcaacaccgcagtattacattagtgctcttggccgcgttattagtggcgtcggttatcggttttggtcatgttcgacagagcttcttcccgccttctaacacaccaatcttctttgtggatatttggctgccttatggtacggatatcagctataccgaagatattgcagccaaaattgaacagcatatcaagcagcaaaaaaatgtagcggataccatgacaaccataggtcagggcgcaatgcgctttatgctgacctacaatggtcaacgtcattatcctaactatgcgcaggtgatggtccgtactgagcaactggagcaaataccgggcttgattgatgaaatcgagtcatatatgcatgacgaatatccgcaggttgatgcgcagatcaaacgcatcatgttcgggccgtcaaacaacagttctattgaagctcgctttattggccccgatccagatgtgctacgcaccttggcagcccaggcggaacaggcgattatcgctgacccaatggccgatggtgcaaggcatgactggcaggatcgtagcaagatgatccggccacaattctccgattatctgggccgcgagttgggggtcgataaacgcgaggtggatggtacgttgcgcatgagttttggtggcttgccggttgggttataccgcgatggtacccgcctgatacctattgtcctacgcacaccggactctgagcggctcaatgctgagcggttgaacgatgtgatggtctggagccaggcgcgccaagcctttatcccgatcgacaacgtggtcaccagttttgaaaccgagtgggaagatccactgattatgcgtctggatcgtaagcggacactgacggtacaaacggatccaacccatcagggcggtgagacctcttccgagttgttgcaacggatcaagccgggcgttgaagccattaccttgccacggggctatgaactggagtggggcggcgattacgaaagtaccaaagaagcacagcggggtattttcattagcttgccgatcgcgtttctgcttatgtttgttgtgaccgtgctgatgtttagctcggtgcgtaatgcactggctatttggctgacggtaccactggcattaattggtgtgaccttcggcttcctactgacggggattccgttcggctttatggccttgctggggttattaagcctgagtgggatgttgatccgtaacggtattgtactggtcgaagagattggtctacagcggcaagagaaaccgttgcgtgaggcgattatcgatgcttccaccgcgcgtttacggcctatcatgctgaccgcatttaccaccgtgttggggctggctccgctgctgagcgatgccttcttccagagtatggcggtggtgattatgtttggcttgggcttcgcgacagtactgacattgctggtactgccagtgatttacagcagtatgaatccagagcctaaagaaaagatccacgatgagccagtgagtgaataattaaccactttgggttataggccctaaaagtaatttcagcagccccggtcagtcacggggctgttttttttttgacgaaccccacttttccgcttttctctccattgatttttctgcttttctcttcattgataggtaatcccctgaaaagtcggtgtgcccataagtctaattttctcgtaatctgaaccggggagagttctatgacccgcagggcagcgaagctcataaatcacgctttaccgacagccagatagctttaccgacaaccagataatagtaatcctgaagcaggccgaggctcccaggcataccaaagccagcgttgctgctttacgatctccgcattgaatacatgatcatcaaaagtagaagaagaggcctgtttcgtactctgttgctttatttacttgagataataagagattaacagcttcattctcactaggatggaaatcattctcgatgagtaaccgtgcttgagtaaggctatcaacgcctactatcttctcatcttcaaactcatcgatacatatgtcgaataagtcattcattaaacgaattaaacctaattccacaagtgaacggtattgttcatcggtgatgttcaaatcgatcacgtcaccatcgatacatttatcaaaatcaagtcgagacatagcctcttggctagtagggacagatatacacttcatgctatttaccaccattaatattaaaataagttacttcgttatactcactttgcgttctaccaacctgcttccctgtctccaaaattttattatttggaatatttccatcaaggtcgaggtatgttctttttccaggtaacgatgggtcatggaggcgaaaataactccctgacaaatcctcttactacctgaacccctgttgttggattcgtataaatttgtttacctgatttagtgactgtaataaacggatcgctacctgcaaacttattcactgcagcccccaaatcacccgaaggccagttttgagagaatatttgagcgcgagctgccctctcagccaatttttcaggtagagttgctaacgtctctagctgcccaatttcacttgttgggttcagtcttctcatcgttagccccgcagcaatcgatgcgccggtgcaatcctttatgatccataacctgatcataaccagctggagcatccccgccaagttgttcagccgtttacggacccctcaacattgccgttataaataatggttagatatatgactaatggcttatttacttgtttatttatatctattgttaatagaaatttagtgaaatttgatttttatcatagagagataaaagtgtgatccacttaaatagaatggcgtttcattttgtgtagagtaggctttcgttattgaacttaacgtgctttttatcaacagctagacgtgatttttatcaatggctaatagcgaacaatcgattttaatctgctggatgttaaaaactgagggtaattcatgccaattaatgctctgagtaagacactattattaggattgatatcatttgccgctttaggtgaagtcagcgcggcacagtacaatgctgtggtttctgccatggcgcagggcgatgagttctcttcaattaatgcagcgttacaatcagcaccgccagatagttctccgtttgttattttccttaaaaaaggcgtttataccgaacggcttgaggtcaatcgtgacaatgtgacgctgaaaggtgaggagcgtgatacgacggtgattggcgcgaataccgccgcgggtatgctcaacccacaagggacgaagtggggaacctctggcagcagcacggtattggtgaatgccgccaattttactgcagaaaatttgacgattcgtaatgacttcgatttccctgctaatcaggcgaaagcagagggtgatccgacgaaattaaaagatacgcaggcggtggcgctgttattagcagaaaaaagtgataaagcccgtttcaggcaagtcaaacttgaggggtaccaagatacgctttatagcaaaacgggcagtcgtagctactttaccgattgtgacatcagtggccacgtcgattttatttttggctcaggggtgacggtatttgaccgctgcaatattattgcccgtgatcgccgtgatatctccccaccttacggttacattacggcacccagtacccaaaataccgcaccttatggtctgattgtcctcaatagtcgtttaaccaaagaaccaggtgtgcctgctaaaagttttgccttagggcgcccgtggcaccctactacagcatttgatgatggccgttatgctgatcctgcggctatcggacaggcggtatttatcaataccgtaatggatgatcatatttatggctgggataaaatgtctggaaaagataagcaaggcgagaaagtttggttctacccgcaagactctcgcttctttgaagcgaacaatcagggaccaggggctgaaattaatgaggggcggcgtcagttgtctgctgagcaactaaaagcgttcacattgccaatgatttttcccgactggaccgttcagtagccttatattaaccgcggtttactgcctttaagctggcggataatccaagaggaggcgtttcacgttttacttctcatcatcatctgatgcggcctatacccaataaggccgccgtcctctagattgacaaatagttctacattgaccaatggctttatattgccgaaaggcgcgttgatgatcagtttagtcatatcccgagtgataaggtgtggtattaccctattgaatattattcaagatcataagtgtttgaatgtgataatgcaggtatcaccagaaaggggaaatgggttgttaaaatgaaaatacgtgagtcagttttttattaaaaaagccattttctttttttttaaaacagagtgaactgcttaaataaaaaggataaaccaactgataagctaattaaattatccataatgagtaataagactgtttaataacggaatggaagtgaaattaaacgtgcagtatttaacttgataatcaatcattaaaaataataactggcatagagcgtccgtatgttcagcgagttaatcaaggggaagactgtacatttgataattcatctttagcaaattcgatgttattgcggccatttctcttggcccggtaaagcgcttcatccgcggctttcaatgacgcggccaagtcataggcttgcaggggggaaatacccgcacttaaggtgaccgtcgtagagaccttatgattaaagacatgtggaatatccaggcctaaaacgcgctgacgtacacgctctgccaattggctggcgtactcttcactgacatgtgttaggagtacgagaaactcttcaccaccataacgcaccacgatatctcttgaacgcacagcatcgcgaatagccgccgaaatccgtaccagagcctgatcgcccatggtgtggccatagttgtcgttataggctttaaagtgatcgatatcgagcagcaggacataatgatttcccggcgactgagataacaacgtttcaagcttgctctccagcccacggcgattatacaaactggtcagagggtctatcatgcttaaatcactgaatttttctctttcgttggaaaggtgatcaaccagcttacgggtgaaattatcagtgcgacgcaacatcaagtgatgcaaagaaaaaccaatcagcggtaacatgatggtaaatataatgcggaaaatattatgaaaatcatccagtaagatgacggttattgccgaaggtgccgtatgcaggcaaaacgcgagaaaattatcagacaaagcaatggtactgataaaaaagatcgtaaacagactgagtaataagtaattatcttcgttagtctctagatattcatatttaagaatgatttgccatgcccaaagtagaccgatgaggattgaaaataaattcaatttattcgcatagttatttttatcaacatggttacttttatcaacatagttacttttatcaacatagttatttctgcccgcgtcgttctttgaaataaaaattagataagccgccgcgctcaagcttataaccgcaatcatcaccacagggaacgttaccgcgggtgtcttgggcgacgatgatagcatactgaaaatagctgatgatgcattaagaaataggaaaagcagtaaagagagtcgatgcttgcttttcaaaagctgatcgtaggagtggctattcatattcaattcactctgcataatatcgtgctgtcagtagactaataaatcatatcctcgtgaggtatttattccgacatcacgacaaataaattttgttgggaattattattgtttaaatcgttttaacattgttttaggatttttcttagccaaaattaccatttttgtttcagcctgtcatcatgatgtcgttcaacggcgcaaaatgatgcatatgacgcgagcgtgcagataacgacatggtgcagagtgccaaagagtgatatatgatattggttatgattatcattatcatttgggtgggcatcatcatgattacatcgacatttgcagcttaccgttcgtgggggatcaccgggttgctcagccgtggcatgtccagtggctggggaatattgctgccttttaccttgttacctgtactgggctgggtagatatctctatcggccaattgcgcattcttattgtcgtggcgatgctggcaaccgtcagcatgttgtaccacgtgcggttgcggcactttttgttactgccatcttgtctggcgctgttaggcggcttggtcgcgctaatgctaatgcacggtggtgtgtcatgatgggggtatccgatcatcggggataatataaaacgtgaggtaatacagtaagtaacagcttggatgattgacgttgaaatggagacgtatgtatatattgtgggtttgctacaaacgtggaaagtggggtgagtacgcagtggaggttacgggaaaactgaaatcattgtggtgcgaagggagggacttgaaccctcacgtccgtaagaacactaacacctgaagctagcgcgtctaccaattccgccaccatcgcccaaatgattccttactactaatttcttactatcaatctatttcttactatcaatctatagccagcggttctacttaggatttatatcaccagcttggtgcgaagggagggacttgaaccctcacgtccgtaagaacactaacacctgaagctagcgcgtctaccaattccgccaccatcgcatgtgctgtgtaatataaatcttactgctattttggggtctgtatcactctgatataccggtaatctgatacacagatttgctacaaaagactgtttggtgcgaagggagggacttgaaccctcacgtccgtaagaacactaacacctgaagctagcgcgtctaccaattccgccaccatcgcgtaccggaacatgacttttgtgatacaaccacgggggcgaattctagagactttcacgtacaggtcaatagttatttcccctaagcgggacgtttgctgtaaaaatcatcatctgttgattcattggcttgataaatgaatggcgtggcttgtgagggggactggatgcgctgttcccgttccatgccgcagcgaatgaatgctacggcgaggaagaggtggcctatcttactgtttgaatcttagtgctttaatattaacgttttttcttcggatcccgtggcggacgcccgacagttgcctgatacactttaaagcggccattctgtgccagcacttcgtggctaccaaatgcggcatccagcaaggcaggatacggcaggaaggagttcgctacgatgcgtaatttcccccccacatgtaggtgggcggtcgctccacggatcagcatctcagcggcggtcaggctggtttggatcccatcatggaaaggcgggttcgaaatgatcatctcaaagcggcctttgatgtcggaatagacgttactggcaattacttgcgcctcaatattattcaccgccaatgtggctcggctggcttcaatggctgcggcactgacatcactcaacgtccatttgatttttggcgattgctgcgccagaaccgaggctaatactccagcaccacaaccgacatccaatacgctgcctttaaagggctcgttaaaggtggacagcaacagatgactacccgaatccagagaatcgcggctgaagacacccggcaatgttttgaccgtcacactaccgacctgatagctttcccaccaggcatcagcatcaaactcgggttgtttgtctaaacggccatggtataaaccacagcggcgagcgctgtctatcttggctaactgcgcgaagtctgccaacatttcttctgcgctgcgtacaccactgcggttttcacccacaacaaaaatatcggtgccaacaggcagtatagaaagcaggttagccaactggaattgggcttcttgtttgcttttgggccagtagtaaatcagggtgtcgcaagctgcgagagtttctgccgtggctaaaagaccgaattgcacattctcttccagcgtgttgctcagtaattgccagtggtgatattgattggtgtgaacccgcaccccggctgcatcaaattgcgctggcagcgcatcttgtaaatcaccggcaaacaggacgtggcgggctataaattcatcactatggcgcagtatcacttcactggctggggttaatgctgacatcagtctttggctccttaataatataatcggggattatagaggtttgttggcgcatgttcgatgggtttgctagcatagcgccaaattacggcttgctctgacaggaaatagcatggcatcaagacgagacttgctgttacagcagcttggcattacgcagtgggtattgcgccgtcctgccgtcttgcagggtgagattgcaatacatttacctgaagatacccgcctactgattgtggcacagcaactgcctgaacacggtgatccactgttgtgcgatgtgctacgcagtttgggcctaaccccccatcaggtttatgccttgacgccggatcaggtcgcgatgttgccggaagatacgcagtgcaacagttggcgattgggcatcagtgagccgcttgcggtggccggtgcacaattacatagcccagaattagctgggctttatcaagatgcgggcgctaagcgcgcactttggcagcagatttgtcattatgaagcagatttctatcctgacgccagccgatctggccacagcgtaccaaattgaacaagccagccatgcgttcccatggacggaaaaaacgttcgccagtaatcagggcgaccggtacctcaattttaagttgagcatcggccaggaaatggcgggtttcgctattacccaaatagtgttggatgaagccacactgttcaatatcgccatcgatccacagtatcagcgccaaggttatggccgtttgctgctcgaacatctgattgaacagttggaggcgcgtaatattgtcacgctttggcttgaggttcgggcttcaaacgcacgggcgatcgccttgtatgaaagcctagggtttaacgaagtgtctgtgcgccgtaactattacccgagtgcgaatgggcgtgaagatgccattatgatggcgttgccaatggcatagcgccgttttattgtttttttatcgtcatcttagacgtgctgatgctttcgccgattgtctatctcgcataaatcagggaaaatatcgcgcaataatcaatgtctcgctttgccggacccacatagcaataaaatgtgaggctcagagcagggcggcctaaaagtagaaacttcaactatgtctcctagtgaatatgctctggaagtcgcgaaaagacgtacttttgcgatcatttcccaccccgatgccggtaaaacaaccattaccgaaaaagtgttgctgttcggacatgcaattcagactgccgggacagtaaaaggccgtggttcaagccatcatgccaaatctgactggatggaaatggaaaaacaacgcggtatctccattaccacgtcggtaatgcagtttccgtatggcggctgtctggtcaatctgcttgataccccagggcatgaagacttctccgaagatacgtaccgcacactgacggcggttgactgctgtttgatggtgatcgatgcggccaaaggggtagaagaccggacccgcaaattgatggaagtgacccgtctgcgcgatacgccaattctgacctttatgaacaaattggaccgcgaaattcgtgatccaatggaagttctggatgaagtcgagcgtgagctgaacattgcctgttcacctatcacttggccgattggttgcggtaagtcgtttaaaggggtttatcaccttcataaagacgaaacttatctgtatcaaagcggtaaaggccataccattcaggaagtccgtatcgttaaagggctgaacaacccagatctggatgtggctgttggcgaagacttggccaagcagttccgtcaggagttggaactggttcagggcgcttcccacgagtttgatcatgaggctttcctgtccggtgatttaacgcccgtcttcttcggtactgcgttgggtaacttcggtgtggaccatatgctagatggcttggtcgaatgggcaccggcaccgatgccgcgtaaaacggatacccgcgtagtggtcgcctctgaagagaaattcaccggtttcgttttcaaaattcaggccaatatggatccgaaacaccgtgaccgtgtggcctttatgcgcgtggtgtctggccgttttgagaaagggatgaagctgcgtcaggtacggaccaagaaagacgtggtgatttcagacgcgctgacctttatggccggtgaccgttctcacgttgaagaggcctatgctggtgatattatcggcttgcataaccatggcaccatccagatcggtgacaccttcactcaaggtgaagatatgaaattcaccggtattcctaactttgcccctgaattgttccgccgcattcgcctgcgcgatccattaaagcagaagcagttgttaaaaggcttggttcagttgtcagaagagggagccgttcaggtattccgcccactgagcaacaacgatttgatcgtgggcgctgtgggggtgctgcagtttgaagtggtctcttcccgcttgaagagtgaatacaacgtcgaagcggtgtatgaatcagttaacgtttctaccgcgcgttgggtcgaatgtaatgacgtgaagaaatttgaggagttcaaacgtaagaatgagcttaatttggccttagacggtggtgataatttaagttacatcgcgcccacgatggttaatctcaatattacacaagagcgttacccggacgttattttccgcaaaacacgcgagcactaagtttattgctaacgaacctgctgcaagccgcattctatcggggtatctattaccccgatccatcaatcttattcgatattttcttgctaggataattcctacttagcgataaaaattctgttttagtccgattccgactgtctttcttctgtgatgctctatctttaataggtacaggcaggattgattagcctcaaacttagatcaataaacctgcaataacggtaactattcgtgaaagggtcaccgccttaaggtggtgtcaggctccttttgttgggtgtttcatatcccatgaaaggattcataacaaaaaggaagatatcgatgaagaacacacaattttcccgttcagtgatggcgattgttttaggttctgcccttattagtggcagtgttctggccgaagacacgctactgaataaagccgccagcacagtggacagtactggtgccaaaatcgatagctccatgaagaaagttgataattacatgagcgatagcgcagtcacggcgaaagtaaaaagcgctttattggaagaaaaatcacttaaaagcaccgatatttctgtcgaaacgagcaatggcgtcgtgacactgagtggttttcttaattctcaggccgaaattgaaaccgcggttgaaattgccggtaacgttgaaggggttaaatctgtcagcgacaaattgcacgtaaaagaccagaaatcacagtcggtcagtgaatatgcgggcgatgctgcgaccaccagcagtgttaaagcaaaattactggcggatgatatcgtaccgtcacgtaaaattaaggtagaaacgaccgatggtgtcgtacagctatcgggtgatgttgagaataaagcccaatctgaacgtgcagaaagtattgctaaagcggtaaacggcgtgaaaagcgttaaaaacgacttgaacatcaagccttaatcattattcagctggcgacgtatggcatggaatatatcctgttggatatcgataaataaggtatccccccaagccgttcgtcaactgagttaatttcctctgagagccaaatgaaagggtgtctgtttaatcaggcaccttatctttaaactggaaggagaagcttatgtttcgttggggcattatttttctgattattgcgttaatcgcggccgcattaggttttggtggattggccggtactgcggcttgggcagcaaaagtggtctttgtggtggggattattttgttcctcatcagtctgtttacgggacgtaagcgcctttaacaaggcagtaggggtgacagcaaaggacaataaggggtatcgtcaacacctgttcgtcatgaattaaggatagatggtgggatacagaatacctattacgctcggtaatattgagccactcgcctataaaccctatcagcccggtaaaatggcgctggtctgtgaggggggcgggcaacgggggatttttacagccggtgtgctggatgaattccatcgtgctcgctttaacccttttgatctcatgattggtacctcagcaggggcgcaaaatttatctgcctttatttgcgggcaacccggttacgcacggcgagttattacccgttacaccaccacagccaatttttttaacccattacgctttgtacgtgggggtaatttaattgatctcgattggctagtggatatcacttcccaacagtaccctctggcattcgatcacgctgaacaatatttgcgtcaggggcgcgagtttttaatgtgtgcttgtcgcagtgatgatttcgaaccaacgtatatttccccaactagagaaaactggctaacagcgattaaagcctctagcgccatccccggtttatatcggcagggcgttgagttggatggggtgagttatctggatggggggatcagcgatgcgatcccggtagaagaggcttatcgccgtggcgcagagacgatagtggtgatccgcacggtgccttcgcaggctcactatacgccgcaatggtttaagcggattgaacaatggctgagtgaaagcagcttgcagcaattggtgcggattatgcagcagcatgagcggagttatcatcgtattcagcaatttatcgagaaaccgccgggcgatgtacgaattttcgaaattttcccatcaaaaccactcgccagtaaggcattggggagcggggcggtggctctgaatcgtgactatcatttaggccgccgctgtggccgctattttctggcaaccattgggcgttggttattacctcgtgagtcgttgggggatagcgataaaacctccatttccctttcacgccacattattcaaccacaaaatattatccaaacaccgaacgttttccaaacaaagaacattaatcagctgaataatacctatgattacagtgggtctaaagaacgctttaccgcggtattctccacagaaccgtctgtcacgttatctgatctcaccgcgccttccgaggtgcaggcaacggcagcacaaataaatgagccccttgatcctacctcactgactgtcgttgatactgaacaagcggaggctaactctttacccgtcgatatcacgttgccaccgaatctgacaaaaaaataaaggtaatactgtgtgatgagaacgccagataagccgatgccgtattttatcgatacccactgtcattttgacttccctccgttcaccggtgatgaagccgcgagtttagcctgtgcggcagaggcgaatgtcaggcaattgatcgttccttcggtcaaggccgcatatttctcccgcattttggcattagccgatcgttatccccccttgtttgcggctcttggcttacaccccctgtatattgccgaacatgaggatgccgatctggcggcactggcatcgcatctggcagataagtcaccgaaattggtcgcaataggggagattggcctcgatctgtatatggatgaaccgcagtttccacatcagttagtgatcctgaatatgcagcttgaactggccaaacagcatgatttgccggttattttgcattcacgtcgctcacacgatccactggctgcagcattgcgtaaagccgcgttgccgcgcgcgggtgtgatacatggttttgcgggcagcttagcgcaggcgcaagcctttattcgcctgggttattacattggtgtgggggggaccatcacttataagcgagcgcagaaaacccgtcatgttatggcctcattgccgctctcctcgttgctcttggaaaccgatgcacccgatatgcctctggcgagttttcaagggcaagccaatcgccctgaacgagccgccaatgtgtttgccgccttgtgtgagttgcgcccagagccagccgatgagattgcggctgagttgatgtgtaatagccagcgtttattttcccttcctccccttcgtccttgaagctgcagcggtgttagcttctctcactcacccgaatcacttacttgagtaagctcatcgggatttgttcgcttgctgccttgctgcaacgacaatgacgttggggaggtccttttatcttcggccttgacgctgcagcggtgttagcttctctcttgactcggcccattcatgctaacaataagcttacatattcagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcacatattgttagttgttgaactttaatgtgattatgatcacatttacatctttgtagttgcttccatttgtgtttatttgtgacggagattacttgatggcgaggtgatgacgttataattgccgacatcatttcaatgtgactaatagccttattattaataggaatatcgacatgctcatgagtttggtcgggatggcagtactgatattaatcgccgtactgctttcaagtaatgccagggcgattaatcttcgcactgtcatcggtgcatttattatccaagtggtgattggtgcgctggtgctatatgtaccggttggccgccgtattctaggggggatgtcggaaggggtggctaacgttattgcttatggtaatgaggggatctcatttatttttggcggattggtttccgacaaaatgtttgaagtctttggcagtgggggttttgtattcgccttacgtgtattaccggtaattgtattcttctcttcattgattgcggtgttgtattacctcggcgtcatgcaaatcgttattaaagtattgggcggtggtttacaaaaactgctgggcacctcgcggacggagtctctttctgccacagccaatattttcgttgggcagacagaagcgccgttagttgttcgcccctatattgcgaccatgacccagtcagaactgtttgcggtcatgtgtggtggcctggcctcggttgcaggctcggtattggccgggtatgcgcaaatgggcgtaccgttggaatatttgattgccgcctcctttatggcagcaccgggcgggttactgttcgccaaattaatggtgcctgaaaccgagcaaacccacgataaagttgatgctatcgcactgatcgcggaagaggaccgcccagctaacgttattgatgccgcagcttctggggcagcctctggtatgcaactggcgctgaatgtcggggcgatgctactggcctttatcgcattgattgcattgcttaatggcattctgggggggattggcggctggttcgattatccgcaactctcgctggaattgattctgggctgggtgttctcgccaatcgcttatctgatcggcgtgccatggagcgaagcaatggtggcgggctcctttatcggccaaaagattatcgttaacgagtttgtggccttcatgaactttggtcagtatttgcaggcggacgagttagtgaaagcggcgggtttacaggtgctctctgaacacaccaaagcgatcatctcttttgccctgtgtgggttcgccaacttgtcttcggtagctattctactgggtgggctgggtagcatggcaccaaatcgtcgtcatgatattgcgcgctttggcctgaaagccgtggccgcagggacgttgtcgaatttgatgagtgcgacgatcgccggcttcttcctggcactgtgatgtataaggtgccgttttgtagaacggcacgtttccccttcattcgacttggttagtcgtctgaggtgccgtttttgtcaaacggcaccggctatcaagcgtattctcaccaatacgctattcttgatacgaatagcgtaatcggggccaatagaccataaatggggttattttgtgattaaaatcacatataattctatttcgttacagatttctattgattaatgtgaaactaaacacatctcatgatgtgctaacgtgctcaaatagcgccattggctggttgattggttgattggttgattgaacgccggagcttgtgtagaaaatcacatgatagaactgattaatacataaccgaaataattatatatccgaagtcattacgtgtcagaacccgttatgtattagaacccgttacctatcggagccagttaataatagtgcggtgagatggatctcaattgccacccaggggagtcccgtggggctatcttcaaggaaccaagtccgctcgccaacgtattgagcttaaccaccgagagataccgccaaggatcttttctgctcataactacatgctcagttttggcaaactgccggaactgaaacagtgttggagagttttatgaccgatttaaccgcctgcgcgcatttgaacgattatgctaaacgcgcgctaagtttgatggatttaaccaccctgaatgacgacgataccgatgaaaaagtgatcgcgctctgtcatcaggctaaaagcccggccggtaataccgcggcaatttgtatttatcctcgctttatcccggttgcccgtaaggcgttacgtgagcagggcactcctgagatccgtatcgcaacggtgaccaacttccctcatggcaatgatgatgttgcgattgcgttggctgaaacccgtgctgccattgcttatggtgccgatgaagtggatgtggttttcccttatcgcgcgttaatggccggtaacgataaaattggcttcgaactcgtgaaaacgtgcaaagaagcctgcgctgcggcgaatgtattactgaaagtcatcattgaaactggcgaacttaagcaagcgcatttaattcgtcaggcctctgaaattgcaatcaaagcgggtgccgattttattaaaacctctaccggtaaagtgccggtgaatgccacgttggaaagtgcagacattatgatccgcactatccgtgagttaggcgtaggcgaaacggtgggcttcaaaccggctggtggtgtccgtaccgcagaagatgccgcgcaatttttgcaattggctgatcaactgatgggggaaggctgggctgatgcacgccatttccgctttggcgcttccagtctactcgccagtttgctgaccacattgggtcaccagagtaacgccaacagcagcggctactaacgttattatcatcattacactgaattgatgcactgtaggctgaaggcctacagtgtcgctatttccgaaagcgcctgtgggcggctttcatcccatattcaggtcaagcagggggatgccttgtttctggcacaagaaattatccgtaaaaaacgcgacggtcagccattgagcgaagaagagattcgtttttttatcaatgggatccgcgataacgttgtttctgaagggcaaattgccgctttagcgatgaccatttatttccacgatatgagtatgcctgagcgcgttgcgctgaccatggcgatgcgtgattccggtactgtgctgaattggaagagcctgaatctgaatggcccgctggtcgataagcactccactggtggcgtgggtgatgtgacgtcactgatgcttggcccgatggtggcagcttgcggcggctatgtgccgatgatctctggccgtggtcttggtcataccggcggcacactggataaactggaggcgatccccggttttgatattttcccggatgataatgcgttccgcaaaattattcagaatgttggtgtggcgattatcggccaaaccagctcgctggcccctgccgataagcgtttttacgcgacccgcgatattacggcaacagttgattctattccattgattacggcctctatcctggccaaaaaattggcggaagggctggatgcattggtcatggacgtgaaggtcggctccggtgcctttatgccaacctactcgttgtcggctgatttggcgcaggcgattgttggtgtggcaaacggggcgggttgcaaaaccacggcgctcctgacggacatgaaccaagtcctggcatccagcgccggtaatggggtcgaagtccgcgaagctgtgcgtttcctgacgggcgaatatcgcaacccacgtttgctggaagtgactatggcgctgtgtgttgaaatgttgctgtcaggcggtttagcgcacgatgaagccgatgcccgtgccaagctgcaagccgttttggataacggcaaagcggcagaagtctttggccgcatggtggccgcgcaaaaaggcccggtagactttgttgaacgctatgacagctacctgcccgttgctaccctaagcaaaccggtatttgctgaacagacgggaatcattactgcaatggatacccgcgccttgggtatggcggtggtcgccctcggcgggggacgccgtcgggcaacggatcccattgattatagtgtagggctgacggaaatggcccgcttgggtacccgtgttgacgggcagcagccacttgcggtgatccatgccaataacgaagatgactggcaacaggcggcagaggctgtgcgtgcggccatcaccttagggaataacgcgccagaagaaacgccagtgatttatcgccgtatcactgaataaacgtcatacttttgttatcgacagcccgtgttacagcgcccaaacggatcggcaattaattatgaatgtggggtggtggagcgaatgaatattcgccgcccccagagcgtgaatccacgcaggagagagcaatgaaacgtacatttattatggtattagattcttttggtattggtgctagtgcagatgccaaaaaatttggtgacgaaggcgcagatacattaggtcatatcgcagaagcctgtgcgcgtggtgaagccaacgtgggccgtagcggcccgttgacactgcctaacctgagccgtttagggctgggtaaagcggcagaagaatcaaccggtaccttccccgttggcttggataagaacgcggatattattggtgcttatggctacgccagcgagctgtcttctggtaaagatacgccgtcaggtcactgggaaattgcgggtgtccccgtcttgttcgattggggatatttcagcgatgtggaaaacagctttccacaggaattgctggataaactggtaaaacgcgccaatctgccgggctatttgggtaactgccactcttccggtacggtgatccttgaccaactgggtgaggagcatatgaaaaccgggaagccgattttctacacctctgctgactccgtattccagattgcctgccacgaagagacctttggtctggatcgtttgtatgagctgtgcgaaattgcccgtgaagagctgaccgacggtggctataacattggtcgtgtgattgcacgtccgtttatcggcgacaaaccgggtcacttccaacgcacgggtaatcgtcatgatctggcggttgaaccccctgcgccgaccatgctgaaaaaactggttgatgagaagggcggtgaagtggtgtctatcggtaaaattgccgatatttatgcacaggttggtatcacacagaaagtgaaggccacggggctggatgcgttgttcgatgccacgatagaagagatgaaaaaagcgggcgataacaccatcgttttcactaactttgttgattttgactcgtcttacggccaccgccgtgatgttgctggttatgccgccgcgttagaactattcgaccgccgcctaccggaattgatggcactggtcaaagaagatgacatcctgatcctgactgctgaccacggttgtgacccaacctggccgggcactgaccatacccgtgagcacattccggttttggtttacggcccgaaagttaaaccgggttcattggggcatcgtgagacctttgccgatatcgggcagacagttgcggcgtattttgggttgtcgccaatggattacggcaagaacatgctttagcgcacaaggctgagctgagcgagtcagttcggcgattaacatttcaattaggttaaggcctctattaggttaaaaccgcaattaagttaacatattaattctctgatttttaaggaaagtgattatggcaacgccacatattaatgctgaaatgggtgatttcgccgacgttgtattgatgccaggggacccactgcgggcaaagtttattgcagaaactttcctgcaagacgtgcgtgaagtgaataacgtacgtggcatgttgggtttcaccggcacctataaaggccggaagatttctgtgatgggccatggcatggggatcccatcctgttctatctatgctaaagagctgatcactgattttggtgtgaagaaaatcatccgcgtgggctcctgtggtgccgtacgcaccgatgttaaactgcgtgatgtagtgatcgggatgggggcgtgcacggattccaaagttaaccgtatgcgttttaaagatcacgactatgcggcgattgctgattttgagatgacccgtaatgcggttgatgcagccaaagcgaaaggggtcaatgtccgtgtcggtaacctcttctctgcggatcttttctacacaccagatccacaaatgtttgatgtgatggaaaaatacggcatcttgggcgtagaaatggaagccgccggtatctacggcgtagcggcagagtttggtgcgaaggcactgactatctgcaccgtttctgaccatatccgtaccggcgagcagactaccgcggctgaacgtcagaccacttttaatgacatgattgagatcgcactggaatctgtgttactgggtgataacgcgtaatcgcgtctcaagcttctccctttccagcggttttttctttcttcagcggtagagatttctgccgctgaattgatttattcctctctgaatcactaacgtgtccccgagaggctatttatcggcaggcttatggtcggtttccgcctgaccgacgagggcttctggcgtgtcatcttcgctttcatcttcttctttaaccggtatattggccgtcagcagataaggggattgctgccaacggctacggcggccttgtaacagggtgcgggccagaataatccccacggccagagccaccagaatcatcagacgcagtaagttagtggtgttatccacttgcttggattccgtcgccaacacgtgggtatccagtgtcatgcgcagaaaaccacttggcccactgttacccgcgatcatttcaactatttggtggttgaaataactgccagggcgtttaccatccagtgccagccggtcgcgtaccttcacattttctccggcgctggcaaccaacgtcccgtcaatctgatagacgctggcatctaaaatacggctggattgcgtcagttgttgaagaatggcatcgactttctggctatcaatattgtcgtcaccgctatccataatgggcgacaagctaaaagcaacttgtttggcgagtgtttgtgccagctcttcgacctgctctgaacgtgctaactggtggctcaggctgaaataggatgcgccttgcatcagtaagaccaataatgccaaacagatcagtacaattgctgttcggtgtagtcgaaattttaatttagcccgtgccataccggttccttacgagaatgataccctgcatacttgatgttgctgcgtgacgcagcggttctgattcacccttcattgactgactgcagcgccaattcttttgggtatggtgactttatgttgccagaagcaagggcgataggatagcttgatgcgttgttttacttgatgcgttagttttaaatgagccgtatatatatattgcgttgtcccggtttctacaggagtaattcatgtctaatagtctgacctattgcgatctgccttcggagatctatcaatggccgggtctgccactttcactcagtggcgacgaagtgatgccgctggattatcgtgccggtcatacaggttggctgttgtatggtagaaaactggataaacagcggattaccgattttcaacgtcagctcggtgcggccatggtgattgtttctgcctggtgtgtggaagattatcaggtgatccggctagcgggtagcctaacaccacgaattaaaacgctggccgatgagagcggccttgatgtcgcgccattgggggcgataccgcatctacggactcccggcctgctggtcatggatatggattccaccgcgatccaaatcgaatgcattgatgaaattgccaaactggcgggtgtgggcgatgaggtggcggcggtcactgaacgcgccatgcaaggtgagttggatttctcggccagtctgcgccagcgggtggcggcgctgaaaggagccgatgccaatattttgaagcaagtccgtgacgacttgccattgatgccggggttggtcagcctggtgcgtaaacttcaggcgttggattggcatgtggctattgcttctggcggttttacctattatgccgaatacctgcgtgacaaattgcggttggtccatgttgccgcgaatgagcttgaaatcaaagacggcaaactgaccgggtgtgtactggggccaattgttgatgcgcaatataaagcagataccctgatcaagctggcggagaaattgaatatcccgctggcacagactattgctatcggcgatggcgctaatgacctgaaaatgatgcaggttgcgggtttaggtttggctttccacgccaaaccgaaggtttatgccaaagcgaaagtggcgatccgtcacggtgatctactgagtgttctctgcattttgaccggcagcttaaagcacgagagtggcaagtaggtcattcgttgataagttatttattcataaatcatttgttcataaatcatttatttataattaagtgtttaatgattttttttcgtaaagtatgcgcgcataagattgaggtgatgacatggcgaaagcacccaaacgggcgtttgtctgtaatgaatgtggcgcagattatccgcgttggcaggggcaatgcagcgcctgtaacgcctggaataccattaccgaagtcaggctggcggcggtagcgtcatcgtctcgtaatgaccgttttgttggttatgctggcgatgccggtgttagccgggtacagaagctgtccgatattagtctggaggagctgccgcgcttctcaactggcttcctcgagtttgatcgggtgctgggcggcggggtggtaccgggcagtgccattctgattggcggtaaccccggtgcaggcaaaagtactctattgctgcaaaccctctgcaaactgtcggaaaacatgaaaaccctgtatgtcactggcgaagagtcgttgcagcaggtcgccatgcgtgcacaccgtctgggcctgcccacggcggggctgaatatgttgtcggaaaccagtatcgagcagatttgcctgatagcagagcaagaacagccacggctgatggtcatcgactccattcaagtaatgcatatggcggatatccaatcatcgccgggcagtgtggcgcaagtgcgcgaaaccgcggcttatctgactcgttttgctaaaacccggggtgtcgccatcgtgatggtggggcatgtgaccaaagacggttcgctggccgggccgaaggtattagaacactgtattgactgctccgtgatgctcgatggtgatggcgactcacgctttcgtactctgcgtagccacaagaaccgctttggtgctgttaacgaactgggtgtgtttgccatgaccgagcaaggtctacgggaagtcagtaatccatcggcgatctttttgagccgtggcgatgaagtgaccgcaggcagttcagtgatggtggtgtgggaagggactcgcccattgctggtggagatccaagcgctggtagatcattcgatgatgtcgaatccacgccgggtcgctgtcgggctggaacaaaaccgcttggccatcttattggctgttttacaccgccacggtggtttgcagatgtcagatcaagacgtgttcgttaacgtcgttggcggggtgaaagtcactgaaaccagcgctgatctggcattgttgatgtcgctggtctccagtctgcgtgaccgcccattaccgcaagatttagtggtgtttggcgaggtggggctggccggtgaaatccgcccggtaccaagtggtcaggagcgtatctccgaggcggcaaagcacggttttaaacgtgccatcgtgccttatgccaatatgcctaaaaagccgctacccaatatgcaggttttcggggtaaaaaaactggccgatgcgttggctgttttagaagatttataaccgtatatgccctaaataattcacgtcgccggtggctgatcaacgcgcaagtaacttgaattatgacgggtatatttatggataatgtcctatttaatagtgccaatcccgcagcatactgtgttatttttgtttagtacgctaaacaaggagaccgcatgctgcagttcgactatctcaaaacggcaattaagcaaaaaggctgcaccttacagcaggtggctgaggccagcggcatgaccaaaggctatttaagccagctacttaacgataaaatcaaaagccccagtgcgcaaaaattagaggccttacaccgttttctcgggttggaattcccgcgccgtgagaaaaaagtcggtgtagtgtttggtaaattttaccctctgcataccggtcatatttatcttatccagcgcgcctgtagccaggtcgatgaactgcacgtcattctttgccacgatgagccgcgtgatagggagttgtttgagaacagttcgatgtcgcaacaacccacggtcagtgaccgcctacgttggttgttacaaacctttaaatatcagaaaaatatccacattcactcttttgatgagcacgggattgagccttatcctcacggttgggatgtgtggagccgtggcgtaaaagctttcatgaatgaaaagggtattgtccccagctttatctattccagcgagagtcaggatgcgccgcgttaccgggagcaactgggaattgaaaccattttgattgacccgcagcgctcatttatgaacatcagtggccgccagatccgccgcgatcctttccgctattgggattatatcccgactgaagtcaaacccttctttgtgcgcacggtagccatcctcggtggcgaatccagtggtaaatcgacgctggttaacaagttagccaatatcttcaataccaccagtgcgtgggaatatggccgtgagtatgtcttctcccatctggggggcgatgagatggcactgcaatattcggactatgacaaaattgcgctggggcaggcgcagtatgtggattttgcggtgaaatacgccaataaagtggcgtttattgatactgatttcgtcaccacacaggcattttgtaagaaatatgaagggcgggaacaccccttcgttcaggctctgattgatgaataccgttttgatctggtgatcttattggaaaataataccccgtgggtggcagatgggttgcgtagcctcggtagtgaccgcgatcgaaaatccttccaaaatttactcgagcagatgttgcgcgacaataatattgaatacgttcatgtcgagtcagccgattatgacgcccgcttcctacgctgcgtcgaactggttcagcaactgctggccgccgatccgcaacggcttgcccgcccttcagtattaacggatgcgcgataaggtgagttttcctgagtatcagtggggggagttgagcatctgatcactctctacgtgctggatatcatcacatgagccgaatatactggctattcggctcaccaaatgagccgaataatgaggctaatcggctcactctccggttgggagatcactatgggtgaaaatatttgggtatggcagcaaaagaaatggcccaatttttattgggatgaggcgcttattcagccacagttgcgtcatgccagatttaaactcgggcaactccttggcgagaaccggacgaatacctcggcagaaaacgcgaccaaaacattagatatattattggcaaatattattgcttcatcaaaaatcgaaaatgaaccactgaatataagatcggtacggtcatctctggcgaagcggctgggtatgattttagaggataattatccaacgtctgatcgaaccgatggtttagccgctatgatgctggacgccattaatgagtgtaaggcagatttaacacttgagcggttgtatcaatggcatgaatggctttttcctaatgatttatggtcgctcaccccgatgaaggctggccaattacgggggcaggagcctatgcaagttgtttcaggccgtatagggaaagaaaccgttcattttgaagcaccgccgcaagcaatcctgtttgatgaaatagagcaattcatcagttggtttaatttatcccgcagcgatagctttcttgacccgctgttacgcgctgcaattgtacatttttggtttgtcactttgcacccctttgaggatggtaacgggcgcatcactcgggcgcttactgatatggcattatcacaggcagatagtcaaagtattcacctttatgcgatgtcagtagcgatccttgataatcgagaagcgtattacgccattttggaacaggggcaacgtggcaatctggatatcactccatggttgttatggtttattgccactttggagcagagtctggatcaggcttcaaaaggtattgaacataccttagctaaaacctctttttggttaaaacataatggcagtggattgagtccggaacaggtaaaagtgcttaatcgcctattagatggcggtgagaatggcttttctgctgggataaatgcgtcacaatatcagaaagtcgcaaaggtgagtaaagcaacagccacgcgtcatcttgctgatttactggcacgtgaatgtattgaaaaactgccgggcggtggacgaaacacgcggtatcaggtgaaataccctgactaaaaaggcctgcgattgcaggcccttctatctgtcaggctactatctgtcaggctactatccgtcagacttctacccgccagccacttactgatgtaaatggctgggaatgtactcagttgccgccttcctgcaactcgatttatttagggtatctcaaaaactatttggtcattttcttatatttaatacggtgtggctcaagtgcttcagcccccagagtgcgtttcttccactcttcgtattcagtaaagttaccctcgaagaattctaccttaccctcatcttgataatcgatgatgtgggtggcaatccggtcaaggaaccaacggtcatgggaaataaccatggcgcaacctgggaactccagcaaggcgttttccagcgctcgcagggtttcgatatccaggtcgttggtaggttcatcgagcagcaacatgttaccgccaacctgtagcagcttagccaaatgaattcggccgcgctcaccaccggataactcgccgatgcgcttaccctgatcgacccctttgaagttgaaacggccaacatacgcgcggcttggcagctcaaagttaccgattttcatgatgtcctgaccaccggaaacttcttcccaaacggttttgctgtcatccatgttgtcacggaactgatcaaccgacgccagttgcaccgtatcaccaagcgagatagtgcctgaatcgggttgttcctggccggatagcatgcggaacagggttgatttaccggcgccgttcggcccgatgatcccaacgattgcgcctttcggcagagcaaaagtcagatcgtcaatcagcaggcggtcaccataagatttgctcagatgctccacttccagcactttgtcgcctaagcgtggacccggtggaatgaacagctcgctggtttcgttacgtttttgatattcaacgctgttaagttcttcaaagcgggccaaacgagctttacccttcgcctgacggcctttaggattctgacgaacccactccagttctttctcaatggatttgcgacgtgcggcttcagaagaggcttcttgcgccagacgggcatttttttgttccagccaagaggagtagttgccttcccatggaataccttcaccacggtccagttccagaatccagccagcaacgttatcaaggaagtaacggtcatgggtgatcgccactacagtgccttcgtagtcatgcaggaagcgctccagccaggccacagattctgcatccaagtggttggttggttcgtccagcagcagcatgtctggtttttccagcagtaggcggcaaatcgcgacacggcgacgctcaccaccggacaaattggcgattttagcatcccacggtggcagacgcagggcatcggcggcgcgctctagttggttatccagattatggccgtcatgggattggataattgcttccaactcgccttgctcttttgccagcttatcgaaatccgcatcaggatcggcatatagcgcataaacttcatccagacgggtcagcgcacgtttgacttcacccacggcttcttcaaccgattcacggaccgtttgttcaagattcagtttaggttcctgcggcagatagccaattttgatcccaggttgtggacgagcttcgccctcaatctcggtatcaaggccagccatgatgcgcaacagggtagatttaccggagccgttcaggcccagtacaccaatttttgcccctgggaaaaagctcagggagatgtttttcaggatatgccgtttcggtggaacaactttaccgacgcggtgcatggtatagacgtattgagccacgttgagtctgcctctctatatcagttttttatagggcacaagtgtagcccgttttgagaagggatcccagtgatccacttcatcctggcagctaagctgcattgccaatggctctgggtctatatctgagcagaataaaggcagaaaccggtttacagccgcaaaccggtaaataaaggacgttaggacgcggtgataataatggcgacgcggcggttttcggctcggcctttactggtgcggttatccgcgacgggctctaacttgccacggccacgaacatcaatattactctttggaataccgacggtagcgagagtatcggctacggctaaggcgcgctggtaggataattgttgattatagtcatccttcccgacggagtcggtatgaccatcaacccgcatatgcttaatccccacatctgacaatatccggccaatcttttgtacggtttgcataccctcagaatttaattttttcacatcactgtcgaatagcactttatttgccaggccaaattcccagccattatcggttaatttaaacccctgctcttgcaatgcggtgatttgatcaggtgttagcccttgtggtttagcctgacaccccactaatagcataaaacccattgccaggaaactgacccaaatacgttgtattaaacgcttgttttgcattttctgcatgtcacctatcctaaactttctgtgttagtcgtattcggctgataggcaaaaatacgcttgccagaccggaagtttttcttcgcctgatacatcgcttcatccgctcgttgtaataatttttccggcgtttgtgcatgatcaggataaacagcaataccaatactgagtgagacggtaatttcacagccttcagccagtattattggtagggccatactgtcgataatatgatcggcaatagttaaaacatcatccaagttgtggataggggtcagtaacaccgcaaactcatcgccacctaagcgagccactaaatcagtttcacgcaataaggcgcggatacggacggcaattgttgtgagcacaagatcgcctgcggcatggccataattatcattgacgtctttaaaatggtcgccatccaggaatagcacggcggtgtgttcgccgggttggcaatcattaagcgtccggctcaagcgcccttcaaaaaacgtacggttcgcgagtccggtcaggctgtcatgggcggcacggtaagccagtgagtcattttcttgcgtcagatgtttctgccacacctcaagctcttccagcaacccgttaaagtcattactgagctcgttcaattcggccacctttgctgaaggaacccgttgaccaaaactgcggtggcggctgacattatgagccacctcagtgatcctcttaagcgagccaacaataccaagcaacatccgccgtgataggaaaagtgcgaccaatgtactgaccgtcaggcacgccaacatccccgccagaccttgtagcaagaaacgcaataagctgccgccatgcccaacaatgacaattttgccaatctcatcgccagcatgaaacatcggtaacacgacaggggcaggcagtatccaacgggcaacaatttgctccatatgatggataggcccatcgtcaggtagcgcccagtaagctatctgacgattatgtttatcaatgatcttcgcttctgccacttcttcattcgaggcaatcagcgccaataactcgttagcctccacgttatcaccaaaaacgacggcggcctcggtggtataactgatggcgcgggcgatcaaatgcaggttgtgatcaacataaacccgtaaggcaaataacgcggcgacggtgaggaaaatacaggctgttactacagacacaatggcgacagacaaatgtatgcgccgcaagacaccagcaagtgtcgggagtttttctgcgctattgtgattttttttcggcttcatagattggttttttatcgtgttcatcgtgcattagccttcttacgggcaagttgcaatacactagggtgaatacgtacaccaccgcgtgctaatgcatccatattgaccttaaaagagacttgtttatcattcagaagtaagcaaaacacgctgccaaatgtgcattcattataatcctcactgatggtgagaattggggttccgttgagctggatggataactgctggcgctgttgcaattcaatgtgacctaaataaaccacatcgcatttactgttgagtgagttattgggaagtgaataacgttgagtttgaaccggatgtgtggtttccatcagtgctggattaaataacatttcagcatagtccgtcggggagataacacacaacctgatcactggcggagccaccggccagcgtgaataactgataatacctaataccattctggcagcagcatcgctacgttcacgcagaatatctgcattgatattactggcggccaataatggggttggtacagccaccaataatgaaagtaagaatagataaacgccccaccaacgcgatcgtacaattcgtctgtgcggaggttcatgatgttcatcactgacgcggttggttgcgcaagtagcggtagtcatttttgcgcttcctgttgggctaaaaagggatgctaaatgtggtggttgaatcggcgttaggtacgacgttattataagatttatatgatgtaataatagtcatatcatcgtaaatttgagatttatcttaaatcttatttatgttattgaaatagaaatataaaaaacccgactgttttccgggtttttgtcaggtagttgatcacctcagataaaggtgaaacgtgccgttgggggcgtcatgacatgagccactgaagcacgagtaggggaagtagacccttcattcactggcctatacacgggggttatttacctcaaaagccccagagctgggctggactgatccggggctttttctcttctgactgatgttaaacggggttattcatgcctttaaagcgcccgataacccatttttctatttcaacaataataaagatggcaatagcaaccagtaaggttatcccccagtaataggcgggtaatggcgcggtaccaaaggcagtattcataaatggcaggtagatgatagctagctgcaacagcaccagtacgccagagactaaccacagacctttgttaacgaatacttctttattcagtgggaaacgatccatcacacggcagttaaacatgtagatccactgagcggtcaccagtgtttgcatgagaacggtacggataaattcggtactgtaaccacggggttctaaataggcttccagggcgaaagcactacaagcaatcaaggtcccgacaaaaccaatccgccaaatggcatgaccatccaatacatggcgggatgggtcacgtggcttacggcgcataatgcctttttccgcgggttcaaatgccagaccaaaggagagggtggtggaggttgccatgttcatccacaggatttgtagtggtgttaatgggatcaccgcacccgcaaggatagcaaagatgattaataaaccttgcgccaggttagttggcaaaacaaacagaatggtttttttcaggttatcgtaaacccggcggccttcttcaacggcactggcaatggtggcgaagttatcatcggataacaccatgtcggcggcttctttcgtcacctcggtgcctttgatacccatagcaatgccgacatcggcctgtttcagcgccggagcatcgttaaccccatcgccggtcatacccacgatttcacccttctcctgcaaggcttttaccagacgcagtttatgttccgggctggtgcgggcaaaaatatcataacgaacagcggcttctgccagttgttggtcatccatatgttccagttggctgcctgttatggaatctgtaccgttgccaatccctaacatggccccgatcgccatcgccgtttcctgatggtcgccagtgatcattttcacccgaataccggcctgttggcaggtagcaatcgcatcgatagcttcagggcgtggtgggtccatcatgccggcgataccaacaaacaccatgccttgttgaatatctttgtgatcgagttcgttgaccggttgatccgttgggcggaaggccgctgccaccatacgcaagccttgtttggcatagcgcgccatttccgcttcccaataatcacggcggaacggcgcaacaccgctgtcggtcagttcttgttggcagaaggtgaacaagacatcaggcgcaccggttaggaagatactgttatctgactgaacctgatggctggtagccatgtatttataggcagaatcgaaaggaattttgccgtgttgggtaacgtggtccagcttgatcccagattttgccgccagtactttcaacgccccttcggttggcccaccagtaatggtccaatggccttgttcgttttgctgaatctggctgtcattacatagattgaccgcagtaataaatgttttcagcgccttattggtgtccaactccgcttgctgctcgcgaccttctggatagatattacctaccggttcatagctttcaccttccacgcggtagcaatgatccgccagaatcacggctttaaccgtcatttcgttcatcgtcagcgtaccggttttatcggagcagacgacggtcatggcacccaaggtttctaccgttggcaacttgcggataatcgcgcggttgcgcgccatcgcttgcacacccagagacagaataatcgaaatgatcgccggtaaaccttccggtaccgaggcgacagccaagctgattaaggccagtagcaactcatcgactggtaggtcacgtaagataaaggcgaaaacgaacaatatcgccatcatcaccaaaatcaggatgaaaatggcttttcccagacgatccatttgttgtaacagaggggtgcgggtcgactccacggtcgccatcatctgattgatatgacccagctcggtatctccaccgctcgcgatgacgacgcctttggccgtaccggcactgatggtggtgcccgagaagaggaggttcttgcgatcaccgatgacggattcgttctcaatgacgccgatctgcttttcaaccacggtagactcaccggtcagaatagcttcttcaatctggagattatgggcttccagtaaacgcaggtctgcggggatcttatcccctgggcgcaaggtgacgatatctcctggcaccagattctgcgcatcaatagtttgtgccttgccatcccgaataaccacggctttgctggaaagcatgttttggatgcttttcaatgatttttcagctttattttcctgaataaagccaattagcgcgttaatcaccgcgacacaaaggataataatggtatcaactgagtgccccatcaaaccttttactaacgctgcggccaacagaatataaatcaggacatcgttaaaatgtgccaggaattgcagtagagggtgttttgtttttctggcaggtagtgcattgggaccatattgcgccaggcgctcttgtgcctctttttggcttaatccttcttcgcggctatttagatgctgcaaagattcttccacagtaagttgataccaagccttaccctctggagggggggaggcacttttagggtttgatgagttttgcattgaaagaaccttctaaaaattaataaatctatctaaccgttttcatctattcagcggcacgcaaaaggaagaataatcttgtatctcccttacgaaactctattcctaaatgataagacttttattaaaaagcaaaaaaaattatgttgaatgagatatttacaacagcatagttatattcagcaaggatagtaggtttttatcaaaatactgccttgatctatgataataaatacgaggaactgagtaatggtcatgctataaccaagtgaataataaacaattaataacttaatcgccccgccgattatcttttgtcttgatctgaatgttcttacctttgtaagccatagcccaaaaatattaatcttccttttctattagcttgtgtaatcgctggctatcaggtgaaactcttagttagtatgtcttactgcctatctgcgacgcgggtacccggctgtgtgagtgcggcaggaaagaagatgaaaccgtagtcggtaaaacgctcggtaaaaaatcgtggtcggtaaaatgtagtgccaacaaccagtgaggaacaggtaaatatgggtaagtggcgatatctggcgattggcgtgtgtctgatggcgacttcaggagtgacattcgccgattctcttgatgctcagcggcagcgctatcagcaagttaaattggcttgggacagcaatcagatggataccgtggcacaactgatgccaacgttacgtgattatcctttgtacccttatttggaataccgtcagttgacgcaagatttaagccaggtgagtacggcgcaagtgaaggattttctgaaccgtcaccccacattaccaccggcgaaatcactgccatctcgttttgtgaatgaattggctcgccgcgaagattggcgcgggttgttaacgttcagcccgacagcgcctaaaccggttgccgcccgttgtaactattactatgccaaatgggccactggtgagcagtctgtcgcttgggaaggggccagtgaaatctggctcaatggccagtcattaccgggcagttgcgataaattattcagtgtctggcaacaagccgggcaccagacaccattggcaacactggcgcgtatgaagctcgcgcttaaagagggtaacgccagcctggtgagttacttactcaaacaactgcccgcagattaccaaaccatgggcactgcactggcaaaattgcaaagtgatcccagtagtgtagaaagctttgcccgcaccgtcgggccgaccgattttacccgttcagcgacaacaattgctttcacccgtttggctcgacaggatgtggaaaatgcgcgattgatgatcccatcattagtacggttacaaaaaatgagtgacagcgagaaacttgagctggaagaggccgtcgcctggcgtttgatgggtaatgatgcgacttacgaacaagctaaatggcgggatcaagttgcgttacgcagccactcaacctcgctactggagcgtcgtatccgtatgtcattgggcagtggtgaccggcaggggctggcaacctggctggctcgtctcccggcggaggcgcaagataaagatgagtggcgttattggcgtgcatcgttgttgttggaacaaggaaaaaaagcggaaggtgaggcaatactgcgtagcctgacgaaagaacggggtttctatccgatggtggccgcccaaaaactgaatattccttacccgattaaggttcaggtggcggccaagccagatgtgtcgctggcgcaacggcctgaaatcgcccgggttcgcgagttaatgtattggaatatggataaccaagcgcgcgctgaatggagctatttggtggccagtcgcagtaaagctgagcaagaggctctggcacgctatgcctttgaccagaaatgggcggatctgagtgtgcaagccactattgttgccaagctttgggatcatctggaggagcgcttcccaatggcatggaccaaagagttccgccagtttacggaggataaggggatcacgccgagttatgcgatggcgattgcacgtcaggaaagcgcctggaatccaaaagcacaatcaccggtaggcgcaacgggattaatgcaggtgatgccgcgtactgcagaacataccgtaaaacggaataatatcgctgggtatctgaatagcagccaactccttgatccggtgactaacattgagataggaacctactatctggaagaggtttatcagcaattcgggcgtaaccgtattttatccagtgcggcttataatgcaggtccgtcacgggtgaatacttggttgggtaacagtggtgggcaggtggatgcggtggctttcattgaaagtatcccattctctgaaacgcgcggctacgtgaagaatgtgttggcttatgacgctttctatcgtcactttatgaatcgccccgcaaaagtgctgagtgacgccgagtggcagaggcgttattgatcgatatctattgttttgatcgatacctattgttttgatcgatacttattgtctttgacgttgcaggtgtgttggcggtgttagtgacttgctcatccacgggcctcgttgctacgaggccactgcaagcagcgttcagtttgtttgtcgtagttaactaaaatggccgctttcttgcctcttgaaatctagtgagtatagataactctatggtatgcttgttgtactagttaaatagtactttgggtggttatcatgacaaaacaatttttgactgacgaaaaacaagtgtcggattcacttaataggcagacggctgggaacccttactctgccgctgatccggcattgtctgccgaagataatcagcactggttgagctttgtcgcgctgttgcaaaacgcgattacacaagatcttcatctgcctttactgcaactgatgctaacacctgatgagcgaaccgccttggggacgcgtgtgcgcattattgaagagttaatgcgcggtgagctaagccagcgtgagctgaaaagtcagttgggtgcaggtattgcgacgatcacccgtggctctaatagcttgaaaacggccccaccacagctgaaaagctggctcgaagcccagttgctagccaacaaacgctaaatggctggtttagagggcgatgggcgttggtaaatctcattgtggaacggcaccagtgccaacaagagggcctggtgatagacactggttcgagttaatttaccttgggtaaaaatcccgattgcgccgccttgctgttttacattcgaaataccgcttaaaaccgccatttcgtcgcccagttcacgtccttgtcggatcccttgtagtataatgtcaggcagcattaaactggcagaacgggattctccccgtgcttgtaagtgttcaattaccatccatgcaaaggtcatattatcttcaatgcctgcttcaatcccaacccaaaaatcagcctccgggcgaacctggcgcgcgttcttaacccgttgacgggcaccaatacgtgtctcagtgctgcctatgggttgcaggggaacaccgctgtcgacattgacaccttcaatgcgatattggccagggccgtaaacatcgtcaaaggcgagggtaatagcgttaattttcgcaggattggtagttgcagcgataacatggtacataatgagtatgaatatcctttaaagcctatctaaaataggttttatctcagataggttttatctcagataggttttgtgcttattttacgcagtataacggaaaaatgacatgttacaggtatacctcgtgcgtcacggcgaaaccttatggaacgcggcacgccgtattcagggccaatcagacagtccactgaccgagattggtattcgtcaggctcacttagtggcgcagcgggttcgtaatcaaggtatcacgcatattattagcagtgaccttgggcgtactcagcagacggcaaaaattatcgccgatgcttgcgggctaacaatggtgacagaccctcgactgcgtgagttgaatatgggggtactggaaaaccgtcctattgacagcctaacacctgaagaagagcaatggcgtaagcaaatggtcaacggcaccgagggggcgcgtatccccgaaggcgaatcaatgacggagctggggcggaggatgcatgcagcgttggatagctgcctggagttacctgctggcagtaaaccgctgttagttagccatggtatggcgttggggtgtttgttgagcacgttgttggggttgcctgctcatgccgagcggcgtttacgtttacgtaactgctcgttatcccgcgttgattatcaggaaagcccgtggttggcgtcaggttgggtgattgaaagtgctggcgataccgctcatttagatatgccagcacttgatgaattacagcgttaacggcgaattggaatgaaatagtcacatttcagcgtagcaggaggcccatctttcggcctcccctgcgggtagaaacgttcaatatcatagccacgtctgcggatcagagccaactgaggcagaatggtgccatacagtgtcagtatgaaattttgtaacccatcaagcggcccatcatagctgaactgcacatactcacctccctgcaagataaccggttggccctcgggtacgttacacggaatatgctgtggttcaattgccgtcgtatagaaaatttcttgctcgtcatctttctccggatttggccgggagtgatgtaatccatacagaactgggggtaattgatcggcatcgccgaggtattgttgccaaaaatgtaagcgtaattcagcacggtgtgttgaaatttgttcaagcgtacaagaataactttgggttatccctaccaaatgttgttcgggtaaggtaataaattcaggttgaggcagggtatatgttcctaagcggatcggtggacatattccagatgagtgccagtcttcagcccgtcggtataatgcgggcgtctgtgcaaactgttttttaaacgcgcgggtaaaagtttgctgcgaatcaaaacgatattgcagagcgatatccagaatagggcgactggttaaacgtaacgcgacagcggcttttgatagccttcttgcacggatataagcaccgatagcattcccggtgacatccttgaacattcgctgcaaatgccatttcgaataacccgctttggcagcaacattgtccagagctaaaggctggtctaaatgactttctagccagctaagcaagtcacgaatgatactggcttgatccataaaacttcctcgtaaaacagcttaaatttagggtattagtaatatgaacagaatagctctggcgcatagtagcaactttttatgttcccgactgcttaagaatttactggtacagtgtgttaaaaagcgtctagattttgatagtaaggtttttaacaagaccttaatgacgagtacaaaaaaattaacgttgaataacgttgttcaacggaatggagtaagtgtatgaaaaaaagttggatattccttggctgtttactttctttgggggcgataactgcccaggcggaggaaattggttcagttgatacggtatttaagttgctgggacccgatcataaaatcgtgattgaagcctttgatgatccagatgttaaaaatgtaacttgttatatcagccgggcaaaaaccggcggtattaaaggcggattggggctggcagaagatacggctgatgcggcaatttcctgccagcaagttgggccgattgagctaagtgataaaattaagaacaaaaaatcagaaggtgccgtggtatttcaaaaacgcacgtctctggtatttaaaaagctacaggtcgtccgtttttacgatccaaaacgtaattcattggtctatctgacatattcggatcgaattgttgatggttcaccgaaaaatgctattagtgccgtgcctatcatgccttggtaataaaattagccagggcgatacctgccatattttaagttaccttcgttagcggttttgattcaccccagtgactcaccgatgtgcgcttctggggattggctctgccgccttgatataaaaacaaaaaagccagcatctgtgtgctggctctttccgtctctattcgcgaaagattactcttctagatcgccacagaaacgatagccttcaccgtggatggtggcgataatttctggtgtatccggcgtagattcgaagtgtttacgaatacggcggatagtcacatcgacagtacggtcatgaggtttcaactcgcgaccggtcatttttttcaacaattcaccgcgggattgaattttccctgggttttcgcagaaatgcagcatggcgcggaactcactgcgtggcagtttgtaatgctcacccgtagggctgaccagtgagcggctattgatatccagctcccaaccattaaatttgtagctttcaaccaaacggcgttcttcgcctacactgctcagattcatggtgcgagacagcaggttacgggcacggatggttaattcacgtgggttgaaaggtttcgtgatgtaatcatcagcaccaatttccaaaccaaggatcttatcaacttcgttatcacgaccggtgaggaacatgagagcaacactggcttgctcacggagctcccgtgctagcaacaagccatttttgcctggcagattgatgtccatgatcactaagttgatgtcattttcagacaggatatggtgcatttctgccccatcattggcttcataaacaacgtagccttccgcctcgaaaatgctctttagtgtgttgcgagtgactatctcgtcttctacgatcagaatgtggggggtctgcatgtttgctacctaaaattgccaacaaaatagaaataggaagtacagaagtctttgttatatcaggatttttattgactggttactcgtcatcccattcatcacatgactaaagtacgtaaacgcgttcttgatgcactttccatcaacgtcaacaacatcgctagcttggtcagggtgttactccctacagccccaaaggtgacaaaagcggcgcatatcctaaccttattaacagcaatataacagtgcgaaccgaatttaccacccaacaaaattacgctttgttgacatatatcaaattcaattgtagcacgttaacacttttgtgaaaaagacttacaagaatactagcttaagggatagtagactaaattatgtgactgattttcactactattaacattaaaatcagaagatcactcacattaagaaaaagtaatttctaatacattgatttttattgttaaaagttaatattctcttggcattatggcgatgagaagctttatctctttagtaccttatttagcacgaaagtgtaaggaaaattatggctaatgttagaggaatgtaaaggtaatggcagggtgccttatttcactctgtttaaaatcactaacgcctataagccttcttggcacgtcaatagttttgagtgtgaataggaattttcagtaaatagccgtaaaaaaaagttaaaaaatattataggggataatcgacctaaaatagatttattatctgctttaatggggtgttttttcatcaaatcccctgttaatttcctgcgggtcagtgaattacgcagaaatgcccttttaatttatctggatgtttagatgaaaaaatttgacttgagggagcgattgctttaaccaatagggggacagcttcaataatgagacagacagataacatgcgatacatcagcctgaacacaacgattattaccaccaccgaaaccacaggttacggggcgggctgacgcgtacaggaaacaacagaaaaaagcccgcacctagacagtgcgggctttttttttcaatcaaatctttgcaaaaaaagtttgcgataaaaagcgcgaaagcgggagagaatcagaaatgcgagtgctgaaatttggcgggacatcagtggcaaatgccgagcgctttatgcgtgttgccgatatcatcgaaagtaatgcgcgtcagggacaagtggctacggtgttatccgctcccgcgaagataacgaaccatctcgttgccatgatcgataaaatggtcgcagggcaagatatctccccgaacatcagcgatgctgagcggatttttgctgagttattgcgtggattagctgatactcagccaggctttgattatgatcgcctaaaagccttggtcggccatgagtttgcgcaactcaaacacctgctacacggtatttcgttgttggggcagtgcccagacagcattaatgcctcaattatctgccgtggcgaaaaactctccatcgccattatggaggcgttatttcaggctaagggttatcacgttacggtgattaatccagtcgaaaaattgttggcgcagggccattatctcgaatccactgttgatatcacggagtctacccgccgtatcggtgccagcggtattccatctgatcacatcatcctgatggctggttttactgcgggtaatgataaaggtgaattggtggtgttggggcgtaatggctctgattattccgctgccgtgctggctgcttgcttacgggcagattgttgtgagatttggaccgatgtcgacggggtctatacttgtgacccgcgtaccgttccagatgccagattactgaaatcgatgtcataccaagaggcaatggagctttcctattttggtgctaaagttcttcaccctcgcactatcgctcctattgcccgcttccaaattccttgtctgataaaaaacacctctaacccgcaagcccccggtaccttgattggtggtgaaagcattgatgaggattctccggtcaaaggcattaccaacctgaataatatggcgatgattaatgtttcagggccaggaatgaaagggatggtcggtatggctgcccgcgtctttgcggtgatgtcgcgcagcggtatttcagtggtgctaatcactcagtcctcttctgaatacagcatcagtttttgtgtgccacaaggtgagttattgcgcgcccgccgagcgctggaagatgagttttatctggagttgaaagacggtgtcttggatcctctggatgtgatggaacatctggcaattatctctgtggtcggtgacggtatgcgcaccctgcgcggtatttctgcccgtttcttctcggctctggcgcgcgccaacatcaatattattgctatcgctcaaggctcgtctgagcgctctatttctgtggttgtcaataatgatgcggtcactaccggggtgcgagtttgccaccagatgctgtttaacacggatcaagtcattgaggtgtttgtcattggcgtgggtggtgtggggggcgcattaatcgaacaaatctatcgccagcaaccgtggttgaaacagcgtcatatcgatttacgtgtttgtggtatcgcgaattccaaagccatgttgaccaacgtgcatggcattgcattagataactggcgtcaggaactggctgaagttcaggagccgtttaacctgagccgcttgatccgtctggttaaagagtatcacttactgaacccggtcattgttgactgtacctcaagccaggcggttgctgatcaatatgctgatttcctgaccgatggcttccatgtggtgacgccaaacaagaaagccaacacttcatcaatgaattattaccgccaaatgcgtgccgctgcgacgaaatcgtgccgtaaattcttgtatgacaccaacgttggggcggggctaccggtgatcgagaacttacagaacctgctcaatgcgggtgatgaactgatgcgcttcaccggtattctgtccggttcactttccttcatcttcggtaagctagatgaggggatgtcattgtcagaggcaacacggcaagctaaggcgttggggtataccgaacccgatccacgtgatgatctctctgggatggatgttgcccgtaaattgttgattttggcccgtgaagcagggtacaaacttgagttggctgatatcgaggttgagtccgtcttaccagcaagctttgatgcttcaggtgatgtggatactttcctggcgcgcctgccatcattggatgctgaatttacccgcttggtagcgaatgctgcggagcagggcaaagtgctacgttatgtcggagtgattgaagacgggcgttgtaaagtgcggatggaggcagttgacggtaacgacccgttgtataaagttaagaatggcgagaatgcgttggctttctatacccgctattatcagccaattccgttggtgctacgcggttatggcgcaggcaatgatgtgactgccgctggggtgtttgccgatcttttacgcacattatcatggaagttgggagtttaaatatggttaaaatctatgctccggcatcaattggcaatgtcagcgtcggcttcgatgtattaggtgcggcggtctcgccaatagatggcacattgctcggtgattgtgtcagcgtaacagccgcagagcgttttagcctgcataatgaaggccgttttgtcagcaagctgcctgatgatcccaaacagaatatcgtttatcagtgttgggaacgcttttgtcaggaaatgggcaaagagatcccggtcgccatggtgctggaaaagaatatgccgatcggttcagggctaggttccagcgcctgttcagtggttgccggcctgatggcgatgaatgagttctgcggccaaccgttggataaagtcacattactcggcatgatgggggaactggaagggcgggtctcgggcagtattcatttcgataatgtcgcgccttgttatttagggggcatgcagctgatccttgagcaggaaggttatatcagtcaggatgttcctggttttagcgattggttatgggtgatggcctatccggggatcaaagtgtctaccgccgaagcgcgggcgattttaccggcgcagtatcgccgtcaggattgcatcactcatgggcgtaatttggcggggttcattcacgcttgtcacactcagcagccagatttagccgctaaaatgatgaaggatgttatcgcggaaccttaccgcactcaattgctgccaggctttgctgctgcacgacaagcggcacaggatatcggtgcgctggcctgtggtatttccggatccggccccacgttgtttgccgtctgtaacgaccaggcaaccgcacaacgcatggcgggctggctacaaaatcattacctgcaaaacgacgaaggttttgttcatatttgccgtctggataccgcaggcgcacgactactgggataacgcatgaaactgtataaccttaaagatcataacgagcaggtcagcttcgcacaggcgatcaaacaaggcttgggcaaacagcaggggctatttttcccgttggagttgcccgagttcgaactgactgagatcgataaactgctggatctggattttgtgacccgtagtagccgcattctgtcggcttttattggtagtgaaattgcaccagatgtcttaaccaaacgtgtgcaggcagcttttgaattcccagcccctgttgcacaagttgaaaatgatatcgccgttctggagttgttccacggcccgaccttggcgtttaaagactttggcgcacgttttatggcacagatgctggccgaagttgctggcgatcaacccgtcactattttaacggcaacatcgggtgatactggtgcggcggtggctcatgcattctacgggctgaaaaatgttcgagtggttatcctttatccacgaggcaagattagtccgctgcaagaaaagctgttttgtactctgggcggtaatattcacacggtggcgattgatggcgattttgatgcttgtcaggcactggttaagcaagcttttgatgatgaagaactgaaaaccgcgctgagtttgaattccgctaactcaattaatatcagccggttactggcacaaatttgttactactttgaagctgtagcccagttaccacaagaggcgcgcaaccaactggttatctctgtaccaagcggtaactttggtgatttgactgccggtttgttggcaaaatctttagggctaccggtgaaacgctttattgctgccactaatgctaacgacaccgtgccacgctttttggttaacggccagtggcagccaaagccaactgtagccacgttatcgaatgccatggatgtcagtcagccaaataattggccacgtgtggaagagctatatcgtcgcaaaatctggcagttgaaggatttagggcatggtgcggttagcgataaaaccacaaaagatacgatgcgtgaattagctggtttggggtatatctctgagcctcacgcggcgattgcttaccgtgtattgcgtgatcagttgcaagatggtgaatttggcttgtttatcggaaccgcacatcccgcgaaattcaaagagagcgtagaggcaattctgggtcaggaattacctttaccaaaaccactggccgtgagagcgcaattaccgttgctatcccatgatttgcccgcagactttgcacaaatgcgggcatttttgatggcattgccgaagtaatcggttattaacaaagctatttttagcctcgtgagtgaagggttgaccgcacctcggggcacttcggcgacttacgtcgctacgaccccaacggcacgtttccccttcatttgactttgtcagcagtctgaggagccattgattggctcctatagctcagaaaataaagggggcaccgcataggttggggatgccatttaccctgcgggtgctttaatgagttggcattctagtttgtgctgctaatatttataaaaaatggagttttactgatatgggaacgtctgcaatagctcattttaaatatgatcttgataaacatgccacttcgctactccgtgttgcatcattggcttcaacttttttcttaaggacccgtttataaagagtgattacctgagagaggttgaggattataattcattttttgggatgaaaaatacaaatataatgctgaatgaattgttgtaattgtattatatgcgctggctctattttccaaccgcacgctaattaaattgaaggtggtgttattctaaagataagcattttcaatcgaagataaattaacttaagcgttgtttttaaattcaattaaatagcatggtaatgatcctaatatttaaacggccaaagtagatttttgcaaccacatatagagttgtttactgacccagatatcatatgaatgcaccttaggaggggactccgctacgggccacgttgtcaataacctcaatctttagttctttgcccacggtctcgttcaagtaaaaagcaggctcgtgggcttatggtgtcacttacagacatattttagtgctgttcagcccgtttaaacacgagttcgtttttcgccgataatcccgcatcaaattcatagccttccagattaaaatcaaccaattgctctggtttggttaacttattctgaataataaagcggctcatcaggccacgggctttcttcgcgtagaaactgattattttgtacttaccgtttttctcatccaaaaataccggtttaatcagtgaaccgcttaatttagcgggtttaacagccttaaaatactcatcggacgccaaattaatcagaatattatcgccttgcagttccagcgcctgattaagtttctcggttatctgatcgccccaaaaggcataaagatctttgccgcgtgggttagccagcttagtccccatttctaaacgataaggttgcattaaatctagcgggcgcagcagaccgtataaacctgacaacatacgcaaatgctgttgtgcaaagtcaaaatcagcttcactgaaactttcggcctgcatcccggtatagacgtcacctttaaaagccagaatagcctgacgcgcatttgcgggtgtgaaatcaggctgccattcactgaatcgagcggcatttaaacctgccagtttatcgctaatccccatcaggctgctgatttgagccggggttagctcgcggcatatctcaatcaatgcttgtgatttatccaacatttcaggttggctaaatttcgttgtcgctaaggggctttgataatcaagcgttttggccggggagataataataagcatcatgacatcctatttataccgtcatacttcaagctgcatatgcgtttggcggccttcgtttagccctgtcacttgactgacgtcagtgcgctagggttcgctctgttgctgcctgcttgcaattcgaattattgaggatatatccaaataatacactgtagcaaaaagtaccggttagccaaaaaaagattggacgattgctaagataggcaagcgggttggtaagagatgatatagtttatcgtaaatatagcttggctaaatcgtctcagcacagcaatagtggacaagtttgctattaacctactcgttttcggctgttttaatcagcgaaaacggttgcgagcggaaaacgacaaagttggtttttttttaatcaatttaacggccttgcaccaaggcttccgcatgttattatcaagacaaggcaaggcttcgaaatcgccaatattgcgaaaggccagaatgtaatgacatgccaaaagttcatgcacaaacgatgagaaacgacaacatgaccgataaacttacttccctacgtcaaatcaccactgtagtcgccgatactggggatattgcggcgatgaaattgtatcagccgcaagatgcaacgactaacccatcgattattctgaatgctgcccaaatccctgaataccgtaaattgatcgatgaagctattgcctgggcgcgcgaacaaagcagcgatcatgctcagcagatcattgatgcgacggataaactggcagtgaatattggtttggaaattctgaaactgatcccaggccgtatttctaccgaagttgatgctcgcttgtcctatgacaccgtcgccagcgtgacaaaagccaaacgtctgatcaagctgtataacgaagccggtatcagcaatgatcgtattctgatcaaattggcctcaacctggcagggcatccgcgctgcggagcaactggaaaaagaaggtatcaactgtaacctgacactgttgttctccttcgcccaggcacgtgcttgtgctgaagcgggtgtgttccttatttctccttttgttggtcgtattcttgattggtacaaagccaatggcgatcaaaaagagttcgcaccaagcgaagatccaggtgttgtttccgtcactgagatttaccagtactacaaaaaacacggttataagaccgtggtgatgggtgcaagcttccgtaatttgggtgaaatcattgagttagccggttgtgaccgtttgactatcgccccttcactgctgaaagagttagcagagagcgaaggcccggtagaacgtaaattggcttacaccggtgaaattcaggcgaagcctgctccattgactgaagcagaattctactggcagcataatcaggatccaatggcggttgataaactggcagacggcatccgcaagtttgctatcgaccaaggcaaacttgagaaaatgatctccgacttgttgtaattgacatcgctgcgggttacgcgcagatcggtatctgaatgaggtggcgcaagccaccttttttattgccgatttactggttcaggtggtttatgaagccagcaaaaataggctaaatacagctatgcttgcattaatgcggtatttctatccatgttgtggtctttctttttatctatgtaatgtcatcactgaagagtgaattttgtgaacgccaacggttgagctaattcggttgcgtagtatcatccactccagataaaaaggtatttcgttgaggtaattacatgaatatattacgtataggtttagtctcagtttcagatcgggcatccagtgggatttatcaagataaaggtattcccgcattggaagagtggctgacaagtgcgttaaccacaccttttgaagtagaaactcgtcttattcccgatgaacaaagcctaattgaacaaacactctgtgaattagtcgatgagatgggctgtcatttggtattgacgacaggtggaactggcccggcaaggcgtgatgtcactcccgatgcgacattggctattgcagatcggcagatgccaggttttggcgagcaaatgcgtcaaattagcctgcattatgtgccaaccgcaattttatcccgtcaggtaggtgttattcgtaaacaagcacttatcatcaatttgccggggcaacctaaatcaattaaagaaaccttagaaggcgttaaagacgctcagtctaacgtggtggtggctggtatcttcgccagtgtgccttactgcattcaactcttagatgggccttatatagaaactaatactgatgtggtagtggcttttcgcccaaaaagtgccattatcgatataaaagactaaatagaaaatttctatgacataagatgccattatgtgcgtgtggggaattttgtacggtatagtcatgttaactttacaaagagtagaaaaatttttcttccccaactctggcttataacggtgtcatatgtctcaagatcacaattcatctcaagtcggctcatcccaaatcgactcatctcaacatcatgttgatcaacaacataatcataatcgtcgattgaataagcaagattacaaaacactcaccttagccgcattaggtggagcgttagagttctatgattttattatttttgtcttctttgctgcggttattggtgatcttttcttcccggttgacatgcctgaatggcttcgtcaggtgcagacgttcggtatttttgctgctggttacttagctcgcccattgggtggcatcatcatggcacactttggtgatttggttgggcgtaaaaagatgtttactcttagcatcttattaatggcgttgccaacactggctattggcatgttgccgacatatgccactatcggtatcacagcacctttactcctactattaatgcgggtattacaaggtgctgccattggtggcgaagttcccggtgcatgggtctttgtggcagaacatgtgccacgtaaacgtattggcattgcctgcggtaccttaacggccggtctgactgctgggattttgttaggatcgctggttgctacagtcatgaatactacgctgggccatcaggcgattttggaggggggatggcgtataccgttcttcttgggtggaattttcggtttgtttgccatgtacttacgccgttggttgcaggaaactccgatctttaaagaaatgcaggcgcgtaaaacattggctgaagaattgccgctgaaatcggtggtggtaaaccataagaaagaagtggttgtttcgatgctgctgacttggttgctctctgctggcatcgtcgtcgttattttgatgacaccaacctatctacagaagcagtttaatgtactgccagagttggcattgcaggcaaacagtttggcgattatcgcattggttatcggctgtgtggttgccggattggcaattgatcgctttggggccagtaaaacctttatcgttggcagcctgatgctggcgatgtcgacatggtcgttctatcacaccaatctgaccaatccagctcagttatttccccactatatgttggctggcttctgtgtcggtatcgttggtgcagtgccttatgtcatggtgcgtgccttcccggcagaagtccgcttcacgggcatctctttctcgtacaatgtggcctatgccatttttggtggtttaacacctattctggtgaccttatggatgaagtcatctgcaatggctccggcgtattacatgctggtgctatcgctagtgggattgttattgggtatttatctgcgtaacgacattaatagtgaagtgaaagttcagatgcctaagagggtgatgaactgagttaattaagtcaattcactttaaaaagcccataattattatcaataaattatgggcttttatcttttttctataccttagaattctgatttaaaggtaaatccgactttttgtttgacgcgtgctgatggctgggaaatagtctcagaaaataatgtcttggcaccttgttgttgtaagtatcgagctagctcgtaaaccgcagcagtgcctgcccctcttactgtaccttcattatcgggcgataagacatagtcaggcaacgttgctgaggccaccagttccacttcatccctattattaaaacgatctgccaagacaattgcgattatctctcccctcaatttggccactacataaatttcccctgggcggttaagaatcaatctacgatgaataatgccagtaacaatatgcccggcatggagaagtttacttaaggcggcattttcatcagagttgatctctttatcaacatcatcatttgtatgagcgccttggtactgctgtccccattgagcgatagtttcactaattttttgtcgcaattcttgggcatgttcaatttcagtgtcggaaagccttgcatcttcagggaatgggcttggtaaaatttctatttcaaaagctaactcatgttgttctactcgttcgctattttcaataatcgttggtggtattggtctatagataaacgatgataataatagctcatagataccgagtggtagttgttctacctgagatggcgtatcttctgacacataaaaaaggctatagtcaaagtaatttagctgagcatagtcaaacgcagttttaatgtggtcaagagtgctatctattgattgtgacataatggctttttttaccgcatgactgagccttttttctacctctgtattttctactgcaacaccggtacttcctgttgtaataatagactgtataattctaccgaaatattctgtattccaagtccgtagactgccaccgaataataatgtgaaatcagtcattatttctagtgtccaatcgatacacggaggtctaacttgacgagtttggcgcgtgctaagtagagagtggatcgataccatacaggtttttgcgacagcaggtaaactgagcgactgattgttatttatattgtcaatataagttagcatcattttatttttatgtcgcccatcagtgcttacttctgttaatgaaccaggctttaatgggaaactttttcctgcaatatgtaacgttttccctttggtattactattgaaatattgatctgctctgaaaataattccatctagttgtcggcatgttccttgtacaatataattataaaggtttaggaatggagtgaatgcgcatattatttgacttgtattttcgatatctctcttttcccaattttgatcgcctgtatctgcggtaataatagatttattaagaattaatggcttgtctgtatttttatttgtgatggttaatgtgggggtatcaccaatcgtgtgttgccatttaaatgaaataatgggtgatagatcgattagttgatcatctaatgtttggatgtattgaacttgtgcgatatctttttctaattgtaatatgaatgaaagcttgtccaatgtgtcaatacgatcaaaagaaaacttggtttccatattatagtcagaaaaaataatttcattctttaatatgctaatatttgggccgtttgttaagttaatttgataatcatcattaattccattcccttgactattaaaagacagtataacttgtttatttactaaacgagaatcatgccagtactcaccgaaagactcaggtaaatctatttcgtgtttttctaaaataatacatttttgattacagtgcagaccttttttttccgatgccttaaggctggtgagttgattatccatggccagagtttttaatgtttctaagttaatgttttctgttaactcgaagaaaggagcattgaaatggtcatttttatagattgttgtcatcattccaagaggaacttttattgattgaatgctgtcattattaataggtaaaacggtacgattagagtcagcaaacccttcagcatcactatataaatctatgtgttgacttgccgctaaacacgtactgtctccttgaaaattatcttctgtataaaaacatactgcaggatctatgtgatatgagtttattttattatatagtccaaatgatttcatctcctttagattaacatcattttttaatttcttttcttttccgctaaaatcaatgccatcataaagagtgattaccatccctggaggaattgaaattgatttaattttgttgtcaaaattactattgatagtggattgtgactcgccctcataggcacaaaatgattcaccagaaaagttttccaactcataaaaacagacctttgcatcatttatatcatttatatcatttgagtaagctgagaatgatattgcggaaacaatactaattaatagtttgttggtttttttcatcggcgctccttgtctgtgttagtttaaaaattacttatcactatcgagccgatgaggattatatgatgatttgtttttttcactttatctatttttcgttactaggattgactattttatggtgtgttttatatgggggttttaattaattgaaattgtgtttagatttgataggtaattaataggggggtattttaactggcggagtggaaagtgaaatcaccttgaatattaatttttacctaatattcaaggtgctgtgtaatataagctgtctaatggtgttgaaattacattacagcttgggtttctaaggtttggctcggtttgccaataggcaatggttcaccaataggcaatatagtacggccatactgttcgttcagtacttctgccattgctaaataaatcgcgctggcaccacagataatgccttcaaaaccagcgaacattaacaaagcatgattatcggtgaagttacctactgccaatagagcaaacaatatcgtcaggctgccaaaaacaaactgtaatgcgcggttagcgggtaaggtgccgatgaacataaacagtgtgaaaataccccacagacctaaatacacgcccaagaattgggcatcagtggcttctgccaagcccattttaggcagcatcaatagaccgactaagcttaaccagaatgcgccataagaggtaaatgcggtggcagcaaatgtgttgccttttttatactccaatagacccgcgagaatttgtgccaggccgccgtaaaaaatacccatgctcaaaataacagagctcagtgggaagaaacctgcgttgtgcaggttgagcaagacggtagtcatcccaaagcccataaggcccaatgggccaggattcgccaacttgatggtgttcataagtcctctgtaattaacagaacgctaaaaaatggatatttatccgaataagtataaggctactgaatgaacgaaaagtcgtcgaaatccctcagtgcgcgcggcatgataatgatccgcgtcgctagagacaatgatcttgaggggggtaaaaagtaattttttttcatcatcccccttgatgctgagtttcgtggccccatcttatttccaaccacaagggctaatcgtggatcagcggatacatacgtcagcaaaatgctgggtgtgaaaaacattgattatgagaatgcgggcagttgaaaataaacaatccgcccatatatagattaataacttgaccgaatatgactttttagtggaggcgttttagatgggtaaaattattggtatcgacttgggtactaccaactcttgtgtagcaattatggatggtactaaagcacgtgtgctggaaaacagcgaaggtgatcgcacaacgccttctatcatcgcttatacccaagatggtgaaactctggttggtcaaccggctaagcgtcaggctgtcactaaccctcaaaatacactgtttgccatcaagcgtttgattggccgtcgtttccaagacgaagaagcacagcgtgataaagatatcatgccgtacaaaattattgctgcagataatggtgacgcttggctggaagttaaaggccaaaaaatggcaccgccgcagatctctgctgaagtgctgaagaaaatgaagaaaacggctgaagattatctgggtgaaccagtaactgaagcggttattaccgtaccggcttactttaacgatgcacaacgtcaggcaactaaagatgcgggccgtatcgccggtctggaagtaaaacgtatcatcaacgaaccaaccgcagccgcactggcttacggtctggataaagaagtgggtaaccgtactatcgcggtctatgacctcggtggtggtactttcgatatctcaattatcgaaatcgacgaagttgatggcgaaaagaccttcgaagtattggcaaccaacggtgatacccacttgggtggtgaagacttcgatagccgtttgatcaactatctggttgaagaattcaagaaagaccagggtatggatctgcgtaccgatccactggcaatgcagcgtttgaaagaagccgctgaaaaagcaaaaatcgagctgtcttctgcgcagcagaccgatgttaacctgccgtacatcacggctgatggcagcggtccaaaacacatgaacattaaagtgacccgcgctaaattggagtcactggtagaagatttggtaaaccgctctattgaaccactgaaagtggctctgcaagatgctggtttgtctgtttccgacattcaggacgttatcctggtgggtggtcagactcgtatgccaatggttcagaagaaagtggctgacttcttcggtaaagaaccacgtaaagatgtgaacccagatgaggcggtagccattggtgccgctgtgcagggtggggttctgtctggtgaagtgaaagacgttctgttgctggacgttactccactgtcactgggtatcgaaacgatgggtggtgtgatgactccgcttatcactaaaaacaccactatcccgaccaagcacagtcaggtgttctctactgctgaagacaaccagtctgcggtaactatccacgtgctgcagggtgagcgtaaacgtgctcaggataataaatctctgggtcagttcaatctggatggtattcagcctgcacctcgcggcatggcgcaaatcgaagtcaccttcgatatcgacgccgacggtattttgcatgtgtctgctaaagacaagaataccggccgtgagcagaagatcaccattaaggcctcttctggtttgaacgaggaagagattcaaaaaatggtacgtgatgctgaagcaaacgcagaagctgaccgtaagtttgaagaactggttcagacccgtaaccaggctgaccatctgatccacgggactcgtaagcagttggaagaagccggtgataaattaccagcagaagacaaaaccgctatcgaagaagcaatgaaaggcttggaagctgcacttaaaggtgaagataaagctgaaatcgaagcgaaaactcaggctctggtacaggtttccgggaaattgctggaaatggctcaacagcaacaagctgccgcaggcggtgatgctggcgataccagtgccaagaaagaagacgacgttgtagacgccgaattcgaagaagtaaaagacaaaaaataatcgcccttaagcgggcacggcagtggtagaccttactgttgctggaaaccagcacgggcgtcgaggaaactctacgcccgtgcacgcatgttaagggtaggaaaaaagagaatggcgaagagagattattacgaggttttaggcgtcagcagggacgccgaagagcgtgaaatcaaaaaagcctataaacgcctggcaatgaaattccatccggatcgtcaatcggaggataaaaacgccgaagagaagtttaaagaagccaaagaagcctatgaaattctgaccgacgcacaaaagcgtgcggcatatgatcaatacggccatgcagcctttgaacaaggtggaatgggaggcggcggtttcggtggcggcggcggtggtgctgatttttccgatatcttcggtgatgtttttggtgacatttttggtggtggccggcgtcagcagcgtgcatcccgtggttcagatctacgttacaacatggatctgacactggaagaagctgtgcgtggtgtaaccaaagagatccgaatcccaacgctggatgaatgtgatgtttgccacggtagcggtgctaaaccggggagttcaccagtcacttgcccaacttgccatggggcaggtcaggtacagatgcgccaggggttctttaccgtacaacaggcatgtcctcattgtcatggacgtggtcaaatcattaaagacccatgcaacaagtgtcatggacatggtcgtgttgagaaatcgaaaacgctgtcggtcaaaattccggcgggtgttgataccggtgatcgcattcgcttaagtggtgaaggcgaggcgggtgagcatggtgcaccgtcaggtgatttgtacgttcaggtacaagtcaaggcgcatccaatcttcgagcgcgaaggcaacaatctgtattgtgaggttcctattaactttgcaatggcggcattgggcggcgaaatcgaagtccctacattggatgggcgggttaagttaaaaatccctgctgaaacccaaacaggtaaaatgttccgcatgcgtggcaaaggcgttaagtctgttcgtggtggtagccaaggcgatttgttatgccgtgttgtggttgaaacgccggttagcctgagcgaaaaacaaaaacaactgctgcgtgagctggaagagagctttgtcggtgctgctggtgaaaaaaatagcccgcgagctaaaagtttcttagatggcgttaaaaaattctttgacgacctgacacgctaatggcgtggttaattagcagctagccagctaataaagtaaaatgaaagaaatcctcggttgatatcgaggattttttttatctgttgaatatggataaatgtgatatgcgttatcaatagatcggtttttacgatcattacgcgtgataaaaatgaatttttttcgatctgataattatcttaaaattcgtgacttgatttgccgagcaaccgctttctgtccgatgtaaggagttattcattgtgacaaatatcattcgtcaatttttacgccaagaggccgcaggtggcctgattctgattattgctgccgctatcgccttgttgatggcgaacagcgccctacaaggggtttatcaatcatttcttgatataccagtctcgataaaaatagcttcgctggatatcagtaaaccgttattactgtggattaacgatggtctaatggcggtgtttttcctgatggtcgggctggaagttaaacgtgagttgatggaaggctctttggcgggccgcgataaagcagttttccccgcgattgcggcattgggggggatgttagccccagcgctgatttacttactgttcaatggtgctgatgaggtgacccgccaagggtgggcgatcccggcagcgactgacattgcgtttgccttgggagtgatggcgctattaggtaaccgggtacccaccgggctgaaggtctttttactggcattagccattatcgatgaccttggtgtcattattattattgcgttgttctatacccagcaggtttcattacaatctttgggtattgctgcggctgctattgctttactggcgtatatgaactggcgtggtgtagggaaaacatcagcttatctgctggtcggcttggttttgtgggtctgtattcttaaatcgggtgtacatgcgactttggctggggtgattgttggctttatgatcccgctgcatacccaagaccaacgctctccttctgaatcgctggagcatggtttacatccgtgggttgcctatttaattttgccattgtttgcttttgccaatgcgggggtctctttacaaggcgtttctctttcagggctgacgtcactactgccaatggggattgcaaccggtctgtttatcggtaaaccgttgggaattttcacttttagttggctcgcggttaagttaggtattgctaaactacccgacgcaataaattttaagcaaatttttgcagtttcagtgttgtgtgggatcggctttactatgtcgatatttatcgcatcactggcatttgaaggcacagatatcgctctgacgacctattccaaactagggatattgctaggctctaccacagcggctgttgtgggttacagcttactgcgtttggttttacccgctcggcggaaggctgttaacgtaaggtaatgtaccatcacgttattgattcagcattgctgcccaagcgcaggcagcaatgcttggtggaatttaaagatggtttgtcgtgcatgaggccatgtatctggcttggcggtatgttaaggagataacaacatgcgaatgtcacatattaatttcaatcatctttattatttttggcaggtttgtaaagaaggctcggttgtgggagccgcagaggcactgtttctgactccgcaaacaatcaccggccaaattaaagcgctggaagggcgcttaggcggtaagctatttaagcggcgggggcggggattggtcccttcagaattggggcaactggttttccgctacgcggataaaatgtttatgcttagccaggaaatgctggatatcgttaactaccgtaaagaatcccacctgttattcgatgtcggcgtcgccgatgcattatcgaagcgtttagtgagtcaggttctggaaactgcggtggttgagcatgaaaaaattcatctacgctgttttgaatccacccatgagatgttgttagaacaactcagtcagcacaaattggatatgatcttgtctgattgcccggttgactccagtcagcaagaggggttgttctcagtgaaactgggggaatgcagtgtcagtttctattgtcgccagcccgtccccgatctacctttccctgccagtttgcagcaaaagcgtttgttgatccccggtcgccgctcaatgttagggcgaaaattactcaactggattaacagtaaaggcctgaaggtagaggttttgggggaatttgacgatgctgccctgatgaatgcgtttgctgtctatcatgacgctatctttgtcgcaccaacgatatacgccgctgatacttatgctaacgatagtgaaattattgaaattggtcgtttagataacgtacaggaagagtactacgttatttttgctgagcggatgatccaacatccggcagtacagcgggtatgtaacaaagatttttcagcgttgtttaactgttaagtcaattcgctgcaaacaggcccactgcaactgagtagtggagccactactgaacgtcataattgccaaacgatagagataaaaaaaccggcctaagccggtctttttacaagcactcaatgtcatgcaattactgcattgcgttgatttgcgcgaccaagtttgacttatgacgcgctgctttgtttttgtggatcagacctttacaggactgacgatccacgattggttgcatttcattaaatgctttttgcgctgcgtctttatcgccagctgcaattgccgcatacaccttcttaatgaaggtacgcaccattgagcgacggctagcgttatgcttgcggcgtttctcagactgtacggcgcgtttcttagctgatttgatattagccaaggtccaactcccaaatatattctattgaggacaattcaaaggccgaggaatatgcccttttagccttcgtttgtcaatggatttgtgcaaataagcgccgtttgtacgggcggcacttgctacgttgtgatggagcgggattttaccagcttcgcgctgcggaatacagtctttcgaaagaaaattccacagtttcactgcctcgaagggattcgacggtggttcttgtaaaaatctcagcctgcttctgtattcaacggcgtacgcattctacaggataaagtgagtaaaagggattttacctgcagattattggcaaaatggtatgactttcggttaaaggtgccaatcgcgggttaaccttaaccgctgtacaaggtataatccggcgattcccactgttttgagccagctatggagctaattcgcggtatacataatatccgggcacgccaccatggttgcgtgctgactatcggtaactttgatggtgtccaccgtggacatcaggctttattagagcaactaaagcgcgaggggcagcgtttaggcctacccgttatggtgatgatatttgaaccgcaaccactggaattgtttgcagcagataaagcacccgcccgattgacacgcttgcgtgataaagccaaatatctggctcaggctggggttgattatttattgtgcgttaagtttgacccacgttttgccgccaatacagcgcaagcttttgttgctcagttgctggtagagaaattgggtgttaaatttttaacggtaggtgatgacttccgctttggcgcagggcgccagggggattttcaactactgcagcaagctggtgctgagtttggttttgatgttatcagcaccgacagtttttgtgatggcggcttgcgaatcagcagcaccgcgattcgtcaggcactgcatgatgatgatttggtgttggccgaaacgttattgggtcacccgtacagtatttcgggccgagtggttcacggtgatgaactggggcggacgataggtttccctacggcgaatttgccgttaaaacgtttagttgctccggtgaaaggggtgtatgcagtagatgtgtatggtttgggttcaacgccattgtatggtgtcgcgaatatcggcacccggcctaccgttgctggcgtccgtcagcagcttgaggttcatctgcttgatgtaactatggatctttatgggtgccatattgatgtggtgctacgcgcaaaactgcgcaacgaacagcgttttgcttcgcttgaggccttaaagcagcaaatcgccaacgatgtggtgacggcccgaacatttttcgggctaaagacaccggtttaatatttctagccgaaacggaaccgagaatctaatgagtgactacaagaataccctgaacttgcctgaaacagggttcccgatgcgcggcgatctggctaagcgtgaacctgacatgctgaaacgttggtatgagcaggatttatacgggattattcgtgcggccaagaaaggtaaaaagacctttattttgcacgatggccccccttatgcgaacggcaacattcatattggtcactctgttaacaaaattctcaaagatattattgttaaatcaaaaggaatggctggatatgattcaccgtatatccccggttgggattgtcatggtttgcctatcgagctaaaagttgaacaattaattggtaagccgggtgagaaagtcagcgctgcagagttccggactgcttgccgtaaatatgccgctgagcaggttgaaggccagaagaaagattttattcgtctgggcgtgttgggtgattgggaccatccttacctaacgatggatttcaaaactgaagccaatattatccgcgcattaagcaaaatcattgataacggtcatctgcataaaggtgccaaacctgtgcattggtgtaccgattgcggttcgtcgctggctgaagcagaagttgaatattacgataagacgtcacaatctattgatgtgcgttttaacgcggttgatacggcaactgttgcggccaaatttggtgtatctgctgttaacggcccaatctcactggttatctggactaccacgccatggactctgcctgctaaccgggctatttcactgaatgccgaatatctttaccagttggttcaggttgagggcgagtgcctgattctggcagccgatctggttgagagcgtcatgaagcgcgcgggcattactcagtgggccgtgttgggaagttgcacaggctccgatctggaactgttgcgctttacccatccctttatgggctttgatgttccagccattttaggtgaccacgttacattggatgccggtaccggtgcggttcacaccgcgccaggtcacggcccggatgactttgttatcggccaaaaatatggcttagaagtggcgaaccctgtcggtccaaacggttgctatctggcgggtacgtatccaacgctggacggcctgtttgtgtttaaagccaacgatgtggttgtcgagttgctgcgtgagaaaggcgcactgctgcacgttgaaaaactgctccacagctacccatgctgctggcgtcacaaaactcctattatcttccgtgcaacgccgcagtggtttatcagcatggatcagaaggggttgcgtaagcagtcacttcaagaaatcaaaggcgtgcaatggatcccggattggggtcaggcgcgtatcgaaaccatggtagcaaaccgcccagactggtgtatctctcgtcagcgtacttggggtgtgccgatgtctctgttcgttcacaaagagaccgaacaacttcatccgcgcagtattgaactgatggaagaagtggccaaacgtgttgagcaagatggcattcaagcgtggtgggatctggatccggcagagattttaggtgccgatgccgcagattatgtcaaagtgccagatacgctggacgtatggtttgactctggttccacccattcttcggtcgttgacgtccgccctgaatttggggggcatagcccggatatgtatctggaaggttctgaccagcaccgcggctggtttatgtcttcattgatgattgctacggcgatgaaaggtaaagcgccttaccgtcaggttctgacccacggttttactgtggatggtcagggtcgcaaaatgtccaaatccattggtaacaccatcagcccacaagatgtcatgaacaagctggggggtgacattctgcgcctatgggtggcatcaaccgactataccggtgagattgctgtttctgatgaaattctgaaacgctctgcggactcctatcgtcgtatccgtaataccgcacgcttcctattagctaacctgaacggctttgatcccgcacagcatcaagtgaaaccggaagagatggttgtagtcgatcgctgggcggttggccgtgcgcaagcggctcaggcagaaattatggaagcgtatgagaattacgatttccatttggtagtgcaacggctgatgcagttttgctcggttgagatgggatccttctatctggatatcattaaagaccgtcagtacaccgcgaaaggtgacggcattgcacgtcgtagctgccagacagcactgttccatattgccgaggcgttggtgcgctggatggccccaatcatgtccttcactgcggatgaaatctggaatcatctgccgggcgagcgtcaacaatatgtcttcactgaagaatggtatgacggtctgtttggtttggcgggcaacgaaagtatgaatgatactttctgggctgaattgttgaaagtgcgcggcgaagtgaacaaagtgttggagcaggcccgtagcgataaacgtattggtggctcattagaggccgcagtgacgttatacgcagagcctgaactggctgctcgtttgaacagtttgcaagatgaattgcgctttgttctactgacttctgccgctaaagtggccgcttatgctgatgcgggcaatgatgctcagcaaagtgaattaattgccgggttgaaaattacctttaataaggctgacggcgagaagtgcccacgttgctggcattacacgcaagatgtcggtttggtagcagagcacgctgaactgtgtgggcgctgtgtcactaacgttgctggtgatggtgaggagcgtaagttcgcctgatgaataaacctatttgctcgaccggattgcgctggttatggctggcagttgtcgttgtcatcttggatatcagcagcaagcagtgggtcatggcccactttgctctgtatgaatcggtgccactgattccttttttcaacctaacctatgcgcagaattttggcgcagcatttagcttcttggcggataaaagtggttggcagcgttggttctttgccggtattgcgataggcatctccgtcgtactgatggtgatgatgtatcgctcaacagcaaagcaacgcctgataaattgtgcttatgcattaattatcggtggtgcactcgggaatttatatgaccgtttagtgcatggcgcagtcaacgattttctcgatttttacatcaataactggcatttcccgacgttcaatttggccgatgtggcgatatgcattggcgctgcgttggttatttttgaaggcttcttaagtccggtagaaaaaaacgcggtgaataacgatgagtgatatgtccgaatttgtgcaagataccgaatcggtacaaaatactggaacggtaaaaacgactacagcggtgcaaaataatggcgctgttttagtgcatttcactctgaagcttgaagatggttcaacggccgagtcaacacgcactcacggtaaaccggcgctctttcgtttaggtgataacagcctttctgatgcactggaacagcaattgttggggctgaccgtgggcgataagcacgcttttacgttacgccctgaagatgcttttggtgtagaaaatccagaccttattcagtatttcactccacgtgattttgctgagactggtgtgccagatgccggcaccatcatgttattcagctctcgcgatggcagcgaaatgccgggtgtcgtgcgggaagtcgcagaagagtctattactgttgattttaatcacccgttggctgggcactctgtcagttttgaacttgaaatactggagattgacccccaacaggaggttgtctatgcagatattgctggctaatccacgtggcttttgtgctggcgttgaccgggctatcagtattgttgaacgtgcgatagaaatgtatggcgcgccaatttatgtacgccatgaggtggtacataaccgctatgtggttgagagcctgtgcgagcgcggtgctatcttcatcgaggaaatttcagaggtgccagatggctccattctgattttctcggcccatggtgtgtcacaggctgttcgggcagaggcccgttcgcgtaatttgacgatgctgtttgatgcgacctgtccattggttaccaaagtccatatggaagtcgcccgtgcgagccgtaagggtaaagaagctattttgatcggccatgccggtcatccagaagtggaagggaccatggggcaatacagcaaccctaacggggggatgtatttggttgaatcgcctgatgacgtttggcagttgaacgtcaaggatgagaataatctgtgttttatgacgcagaccaccttatcggtcgatgatacctccgctgtgatcgatgcgttgaacacgcgcttcccaaagatagtcggcccacgcaaagatgatatttgctatgccacaaccaatcggcaagaggcagtacgtaatctggcaaatgatgctgatatcgtattggtcgtggggtcgaaaaattcctctaactctaaccgattggccgaactggtacagcgaatgggtaagcccgcttatctgattgactctgctgcagatattcaggaattttggttacagggcgcccagtgtattggtgttaccgcgggtgcatctgcccccgatattttggtgcagcaagtgattgcacgcttaaaagatcttggtgctggtgaatcgattgaactcagcggtcgcgaagaaaatattgtttttgaagtaccgaaagaactgcgtgttgaggttaaacagatcgactgattcaggtgtttctttgtcgatcaggtaggtgtttactcgatatgtatttactgacgaaagcagccctttgcggctgcttttttattgtgcccagaaaacccccagctaggctgggggttcagtaaagctttcagctttgggtcagttataaaaaccccttttgatttgttaaaacagtttgcggtctggcaactgcaaatgttcaacaagaaatcaaaagggggtcccaatgagggatgaaaagagcttagcgcacacccgatggaactgtaaatatcatatagtttttgcgccgaagtaccgaaggcaggtgttctacagggaaaaacgcagagcgattggcagtattttaagaaaactgtgcgaatggaaaaacgtgaatatcctggaagcagaatgctgtgtggatcacatccatatgcttctggagatcccgcccaagatgagtgtctcgggatttatggggtacctgaagggaaagagcagtctgatgctttatgagcagtttggcgatttgaagttcaaataccgtaacagggagttttggtgtcgagggtattacgttgatacggtagggaaaaacacggccaggatacaagaatacataaagcaccaattggaagaggataaaatgggtgagcaactctcgatcccgtatcccggtagcccgtttacgggccgtaagtaatccatagatgcaaatgtcagatcgcgatgcgcctgttagggcgcggctggtaacagagccttataggcgcatatgaaaaacctccggctatgccggaggatatttatttgtgcccagaaaacccccagctagtctgggggttcagttggagtacgaaggggcgattgagattgtccctgtggcaatcgaacctcatgcagatgcggcacgacaaaatagtgtacaaaataattgcatgaatatgcgaaatggtaacaaaaggcctataaatagttagagagccttaacagaataaagaaggcctttacctacccgtaaaatttcactaactgctgtttattcagtgttatgtaacggattaagtggtttcactgataaaaatgcacgagtatcatttttttctaatacagattaaataggctggtagagtcaatagccggcggctaatctgaaccctggtcagggtagaggacacattttaaggggacgtatgactgattcaacaattcgtattgctattgtcggcgcgggtggacggatggggcggcaattaattcaagccgttacgcagatggaaggcgttgtcttaggggcggctatcgagcgtaaagggtccacgttggtaggcagtgatgcgggtgagctggcgggtgttggcttgttaaatgtcattgtcggcgatgacttatcccaacttactgataattttgacgtactgatcgactttacccgcccagaaggtacgttggaacatttagctatttgccgtcagcatcggaaagcgatggtgattggtaccacgggttttgatgaggcaggtaaagcggccattagtgaggctgcggcagacattggtattgtattcgcagcgaacttcagtgttggggtgaatgtggtactgaaattgctggaaaaggcggcgaaagtcatgggcgattataccgatattgaaattatcgaagcccatcaccgccacaaagtggatgcaccatcaggaacggcgctggcaatgggtgaggcgattgctgatgctatggggcgctccttgaaagattgtgcagtttatagccgtgaaggctataccggtgagcgtaaaccggggaccatcggtttcgcgaccgtgcgtgctggcgatattgtgggtgaacacacggcaatgtttgctgatatcggcgaacgggttgagatcactcacaaagcgacgagccggatgacttttgcccatggtgcggttaagtctgccatttggcttggtaagcatgataatggcttgtttgatatgcgtgatgtactgaatcttaacgaactttaatgctttaaattacaaccagtgatgtggttgtttttatcataatcatttgataatagggcaatattttattgtccttttttattttaaatttaaaataagcgcttagtgtctttttggttaaataatgtgttttttattgcatttagtcttgaatttatctctttaaatccttcgtttagcccacctagtgtgtttttaactgctgagaacgatatttttcagtgagccgccatcgcaaccgtttactctgctaagttagcttgtatttttaccgctataatccgcacattttgatgagaacggcaaaaaatagagaaaaaatggtgctttggctagacaaaagcgttactcatcattaaaatgcgcccaatttgccaaaaattagctttgagagcggtttttgcattgatttagatcgctagatatgaattaatatgcagataatgtgactgtttattccctggaggatgttttgattaagtcagcgctattggttctcgaagacggaacccaattccacggtcgggccatcggggcagaaggtacggcagtaggggaagtggtcttcaatacgtcgatgaccggttatcaagaaatcctcactgatccttcctactcccgccagatcgttactcttacttatcctcatatcggcaatgtcggcactaatgcctccgatgaagaatcctctgcagtacacgcccaaggtcttgttattcgcgacctgccattgattgccagcaactaccgtaatgaagaaggcttatccgagtatctcaagcggcacaatattgtggcgattgccgatatcgatactcgtaagctgactcgcttgctgcgcgaaaaaggagcacagaacggctgcattattgttggggagttgtctgacgcggccctggcattggaaaaagcgaaagcatttccaggcttgaaagggatggatctggcgaaagaagtgaccaccaaagagatgtatcagtggctgcaaggcagttggacgctggaaggtgatttacctgcggcgaaacaaccagaagatttgccattccatgtggtggcttacgattatggtgtgaagcgtaatatcctgcgtatgctggttgatcgcggttgccgtctgaccgttgttccagcgcagacacccgctgaagacgttctgaaactgaatccagatggcatcttcttatccaatggtcctggggatccagaaccatgcgattacgcgatcacggccatcaagcgcttcctggaaacggatattccggtattcggcatctgtctgggccaccaattgctggcgctggccagtggcgctaaaacagtaaaaatgaagtttggtcaccatgggggtaaccatccggtgaaagatctggatgctagctgtgtgatgattaccgcgcaaaaccatggcttcgccgttgatgaaacctcattgccatccaacctgcgtactacacatgtctctttatttgatggttctctgcaagggctccaccgtacagataaagcagcgttcagcttccaggggcatccagaagccagccccggcccgcatgatgccgcgccattgtttgatcattttatcgaactgattgaggcttaccgagcttcatccgtgagtcttaactgtagtaacagccataaataatcaggagcgaataccatgccaaaacgtacagatataaaaagcatcctgattctgggcgcaggcccgattgttatcggccaggcttgtgagtttgactactccggtgcccaagcgtgtaaagcactgcgcgaagagggttaccgtgtcattttggtgaactccaatccggcgactatcatgactgacccggaaatggccgatgcaacttatatcgagccaattcattgggaagtggtgcgtaagattatcgaaaaagagcgtccagatgctgttttgcctacgatgggtggccaaactgcactgaactgtgcattggaactggagcgtcagggtgttctggcagaatttggcgtcaccatgattggtgcgaccgccgatgccatcgataaagccgaagaccgccgtcgctttgatatcgcgatgaagaagattggtctggatacggcccgctcaggtattgcgcataacatggaagaagcactggctgttgccgctgatgtgggcttcccgtgcattatccgcccatcctttacgatggggggcactggtggcggtatcgcttataaccgtgaagagttcgaagagatctgcgagcgcggtctggatttgtcaccaaccaaagagttgttgattgacgaatcgctgattggctggaaagagtacgagatggaagttgtccgtgataaaaacgacaactgcatcatcgtttgctccattgaaaacttcgatgcgatggggattcacaccggcgactctatcactgtcgcaccggctcagaccctgaccgataaagaataccaaatcatgcgtaatgcctcgatggcggtactgcgtgaaatcggggtagaaaccgggggctctaacgtacagttctccgtcaacccaaaaaatggtcgtttgattgtcattgagatgaacccgcgtgtttctcgctcttcagcactggcctctaaagcaaccggtttcccgattgccaagattgccgccaaactggcggtcggttacacactggatgagttgatgaatgacatcaccggtggccgtactcctgcgtcctttgagccttctatcgactatgttgttaccaagatcccacgctttaactttgaaaaatttgcgggtgccaacgaccgtttgaccacgcaaatgaagtctgtgggtgaagtcatggccattggccgcacgcagcaagaatcactgcaaaaagcactgcgcgggctggaagtgggcgcgaccggttttgacccgaaagtgagcctggatgatcccgaagcactgactaaaattcgtcgtgaattgaaagaagcgggtgcagaacgtatctggtatatcgctgatgctttccgtgcgggcatgtcggttgatggtgtgttcaatctgaccaatgttgatcgctggttcctggtgcagattgaagagctggttcgtctggaagagagcgtggcagaactcggtatcaacggcttgactgctgaatttatgcgtcacttgaaacgtaaaggtttcgccgatgctcgtttggctaaattggtcggtgcagcagaaagtgaagtccgtaaactgcgttacaaatatggtttacacccggtttataagcgtgttgatacctgcgcggcagagttctcgacggatacggcttacatgtactccacctacgaggaagagtgcgaatctaacccaaccagcgatcgtccgaaagtgatggtgctgggtggcggcccgaaccgtatcggacaaggtattgagttcgactattgctgcgtacacgcttcattggcactgcgtgaagacggttacgaaaccatcatggtgaactgtaaccctgagacggtttcaaccgattatgacacctctgatcgtctctacttcgagtcagtcacgctggaagatgtgttggaaattgtccgtattgagaaaccacagggcgttatcgtgcagtacggtggtcagacaccgctgaaattagcccgcgagttggaagcggctggcgtccccattattgggaccagtccggatgccattgaccgtgccgaagaccgtgagcgtttccagcaggcggtaaatcgtctgggcctgaaacagccagcgaatgccaccgtagcgactatcgagcaggcggtggaaaaagccactggtctgggctatccactggtcgtacgcccttcttatgttttgggtggccgcgcgatggaaattgtttatgacgagattgacctgcgccgttacttccagaatgccgtcagtgtatcgaatgatgcgccggtattgcttgaccgcttccttgatgatgccgtcgaagtggatgtcgatgccatttgtgatggtgaacgcgtgttgatcggcggcattatggaacatatagagcaagccggggttcactctggtgactcagcctgttcattgcctgcttacaccctgagcaaagaaattcaggatgtgatgcgccaacaagtggaaaaactggcctttgaactctgtgtccgcggcctgatgaatgtgcagtttgcggtgaaaaacaacgaagtttacctgattgaggttaacccacgggcggcccgtactgtacctttcgtgtccaaagcgaccggtatgccactggcaaaaattgccgctcgtgtgatggtcggccaatcgctggctgagcagggcatgctggaagaaattattccgccttactactcagtcaaggaagtggtactgccgtttaataaattccccggtgttgacccaattttagggccagaaatgcgctctaccggtgaagtcatgggggttggccgtaccttcgctgaggcgttctctaaagcgatgttgggcagtcaatctggcatgaaaaagagtggccgtgcgctattatccgtccgtgagggggataagcaccgggtggtagacttggcggcgaagctgctaaaacaaggctttgaactggatgcaacccacggaacggcggtcgtgctgggcgaggcggggataaacccacgtttggttaacaaggtgcatgaaggccgtccgcatattcaggaccgtattaagaatggcgagtacacctatatcgtgaataccacagctgggcgtcaggcgattgaagattctaagctgatccgtcgcagtgctttgcaatataaagtgcattacgatacgaccttgaacggtggttttgctacggcgatggcgttaaatgcggatccaaccgatcaagtgatttcggtgcaagagatgcatgccaagattaagaatatgaaagcgtaattgacgttttcatccgtggcgaaaatcaagggcgatggcaacatcgccctttttacgttcgcagcttagtcacggggtgtatggcaataaaggcaagatttctcttaggcaaccttggtgaagatcaatgttattgccaacactattgtggatagtaaacggtcattgtagatggccatctcagtagcgaaatacttaaccgagatgctggggttgatagcggtgttagcctaatgcgactttgatgccaaggccgatcaacaggccgcctaacactttatcgaccactttttgtgttttggctaaaccacggcgtactggcgcgctttggatcaggatcaccagcacaggccaccagattgcggacagtatccagatgattgaggcataccagagtttttctcctatgccggagtttatctgcaatatttgcgtgaaaacggcgaggaagaaaagagttgctttgggattcaataagttgcagaggtaaccttgcaaaaatgcggctttgagcgagatgggatactgtgcagtattatcaatactaaacttactttctccccgtgacagcagtgcttgaataccaatccagatcaggtagcaggccccggcatatttcagcaaattgaataaccatggtgtagtcgtgataacgaccgccagaccggccacgcagtaagacatatgcgttgcaacacccaaaattacaccaagtgccgtcatcatggcggcagtgcggcgatagcgggcagcgtttttgatcaccagaaaaaaatcaggtccgggggagatcattcccaatgtcgcgagtgtcgcgacgaataacgaggtttcaagcatcttaattaccgaatgggagtgaagcaatctggcgataataacgccacttagcattctttgcattactcttattggttatctgatgccattttgttattagcagtgatgggatttagtctttctgacctgacgctacagcgccgcgagcgaaaaatcatcaatgtaatttaattcattgaaatttataggttttattctgattgctagcataagtgcggttcaaataggttcccaacgatttgccatttgtttactgtaatgccaataacgttggatctctcttctactcttttgacggatagtgatgcacgaatatgagcctggagaatgtaataaacagtgatgtgccgcatcatcagcagcgagatattactcggttatgtatcaaatgtgccctattgctgttgcaacatggcgcagaaagtatgctggttgagcagttatcggcgcgtcttggtatggctctgggtatggatagcgttgaaagttctatctcggccaatgcggtggtgttaaccaccattagccagggaaattgcctgacatcaacccgcaagaatacggatcgtggcattaatatgcaggtagtcactgaggtccagcatattgtgatcctcgcagagcaccgtttgctggatgcgaaagacgtagaaaaacgctttgaaaatattaaacctctgcgttacccgcgctggctggtggttatcatggtggcgctctcctgcggttgtttcagtaaattgaacggcggcggttgggatgccttctctatcagctttgtggccagtgggctggcgatgtttgtacgccaaagcctgacggcccgccatatgaatccattaattaatttctgtattaccgcttttgtggcgacatctgcctccggtttattaatgcgtttaccatttttcgagcaggcctccagtgtggcgatggcggccagtgtattgttattggttccgggtttcccgctgattaatgcggtggcagatatgtttaaagggcatgttaatacggggctggcgcgttgggcgatggccagcttgctgaccttatcaacctgtattggagtggtgttcgcgatggcactttggggtttgcgggggtgggcgtgagtttactgtgggcattactacaggacatggtgttagctgcgatcccggcgttgggctttgccatggtattcaatgtaccggtccgtgcactgcgttattgcgcactattgggggcaatcggtcatggctcacgtatgttgatgatccattttggtatgaatatcgaactggcttcactcgtggcttcaattatgattggggtgattgggatcaattggtcacgttggctgcttgcacaccctaaagtttttactgttgcggctgtcattcccatgttccctgggatttccgcttataccgccatgatatcggtggttgagatttctcatctgggttatagcgaagcattaatgtctacaatggtgacgaatttcttgaaagcctcatttatcgtcggggcgttgtcgattggtttatcattgccaggactatggttatatcgtaaacgccctggtgtataaggctttttttaaaatcggccactacactaggctaggagcagtcctatatgtatcattcgcttacttatcgctatcgacgcttgattaggctttacgtatagtgtgaacaatttttcgggactggctcttgcagcctacagggtttaataatgattatcagcctgatcgctgcattggcagcagatcgcgttattggcatggaaaacgctatgccatggcatttaccggctgatttagcgtggttcaaacgtaacacgttaaataaaccggtaattatgggtcgtaagaccttcgaatctatcggtcgcccccttccgggaagactgaatattgtcatcagtagccagcctggcactgatgaacgtgtgacgtgggcggcctcgattgaagaagcattggcgtttgctggcaatgcggaagaagtgatggtcatgggcggtggccgcgtctataagcaattcttagaccgcgcaaatcgcatgtatctcacgcatattgatgcggaggtcggtggcgatactcacttccctgattatgagccagatgaatgggaaagcgtattcagtgagtttcatgatgccgatgaagctaactcacacagttattgcttcgaaattctagagcgccgctaataatatattcacatcaaaacaattagcatacaggcccattaggtaataatgggcctgtttcatttagaaaaataaaattattacttaatggataaacgtcattattatttaatatttttagctttcgttctgcatgatagattctaatggctggtttacataaggttttaattatatttttaattttattgcccatgaggtgtaaaatgaaaaaaaatcaacattaataatgctatcgtctttatttttactttcccattttgcttctgctatagaaataacaagatgtccagaagctaatgaaattaaccatgtgttgagcgattataaattggctaatctacgttgatatggtacgacgcaaggaggtgagaataaaggtaatgtagctcgtttcctgcaagcgttttattatcctcatggagggaatgatcgggcgctaggtgttttagttcaatgcagctacctgctggatgccggtattttacaaatgaaagtgagagataataaggttctggtaaacaaaggattgtatatatctattgttgataatccaacgtggataaaaatacagatcatgttccttatacaagctacacctgtagtgcggataaagccgaagactgctcttttacacggccatctgatgagattattacagagatcgcgccagacattccggtcctcttgcctagggtggctgtcgagtaatagtgttaataatatcactcaaaataaaataaccttactattcagtcatatgtgagagaatgttgattccgttaaattgaaaaggttatttttttgatggggtaaataataaatttgaggagaataaatgaaaaaatctatgctgtttttatctctaatattgtctgcgccatatattatggcgaatgaactctcttcctgcccaaataaatctgaaataagttatcagcagggggtttatacaacacctgatggtaaatggttaggggtgtcggttggtgtggaaaatagcggagatgtacgacatttcctatatgtaaagtatattccttataatgcatttaatatggatattggcaggctaaataattgcacttacgctttagcatcaggcagtgttgatatgtatttttatgatgagcgagcattagctctcgaaggtgtatttgtttcacttatggggcatatgttctgggaaaaaacaaccacatcaggtaaggaatcttatatttgtacggcgtcatcagtaaatgactgtacatttacacggcttgacgatgatgttgtagatgattataaaaatagacagtgatgctgttaattataggtgaaatctaaagacgcataagctcatgcgtctttaattagcgtctttacaagattaatttggcatcacaccaattagtgttgtacttcttcgcctgctgcaaatccattgttattattaatttcagcttcggctttgaaggcgcgctgtgtgaaataacgtttatcttcccaacgaagtagggttaaatcccctccccagcaacagccagtgtccagtccatatatcccctctggtacacctttaccttccaatgatgcccaatgaccaaaaataattgaatattcagggtcaacgagccttggtaggtcaaaccaaggtttgagaggggctggcgcgttttctggcgtgtctttgcagatcatatcaagttggccattcgggaagcaaaagcgcatccgcgtaagtgcattggtgctaaagcgcaaacgtgccagcccggtaagctctggtgaccagttgtttggcatatcaccgtacatcgcatccaaaaatagcggataactgtcgctgctcaataccgcttcaacttctcgcgcacacattttggctgtttcaatatcccactgtggtgtgatgcctgcgtgggccataatcaatttaagctggtcatcaacctgcaaaacgggttggcgacgtagccaattaattagctcatcagcatcgggtgcatccagcagtggggtaatacgatcttttggtttattacggctgatgcctgcgtagactgccagtaaatgcaggtcatggttacccagcaccatacgaactgcgggtcctaacgaacgtacataacgtaaaacatccaatgaagcgggaccacgggcaactaaatcgcccgtcagccataaagtatcctgctgtggatcgaagttcacctgggctaaaagcgcaagtaattcatcgaggcagccatgaatatcaccaataagataagtagacatagttaatgagtcagggttaatggatcagggctgggatcgctaagcggaataccggaattacagtacggaaggcctgtccaaggtgatcaatcatttcataatgtccttccatagtacccagcggggtttccagaacggcaccgctggtgtattgaaattcattacctggcaggataagtggttgttcgccgataaccccttctccctgaacttcagtctggcggccattgctattggtaattaaccaatagcggccaagcagttgcacgtttgaacgccctaaattacgaacagtaacggtataggcgaagacgaaacgctcctcttcgggtatcgattgcgtttccacatagatactttgtacctgcacacaaatacggggctgttcaatcatgatgtgctcctgcttatttctgcggtgtcgattgagctgaaagccagttagctagcttacagtattgcgctaccgaaatattttctgccctgagtatcgggtcaatacctaattcgattaattgctctgaagtgaataaatcacctaagctattgcgcaccgtttttctacgttggttaaaggcttgcgtagtaatacggctcagcatacgaacgtcaccgaccgggtgaggcatttgcacatgtggaatgaggcgcacaactgcagaatcaactttaggggctggagtaaacgcagtcggcggtacttccaaaaccgggatcacattgcaatagtattgcgccatgacggtcagacggccataagctttactgttggggccagcaaccaagcggttaacaacctctttttgcaacatgaaatgcatgtcgcggatagcatcagtatagctgaaaagatggaacatcagcggtgtagaaatattgtacggcaggttaccaaatacccgtaatggttgccccgcctgctctgacagttcggaaaagtttactttcatcgcatcttgctgatgaatggttagcttatctttcagttgaggatggctagccagccgtgcagccagatcgcgatccagctcaatgacggtcatgtgatccatacgagccgcgacgggttcggttaaggcacctaaaccggggccaatctcaacgaccgcttcgccaggaactgggtggattgcggagacaatactgtcgatgacaaactgatcgtttaaaaagttttgtccaaagcgtttgcgggcaaaatgcccttggtggactctattattcattgctgttatttatcattttgatggctaagtttaatgccgtaatgaaactgccaacatcggcagtaccggttgcggcgagttctaaagcggtaccgtgatccacagaagtgcggataaaaggcaaaccgagagtgatattgactgctcggccaaacccttgatatttcaatactggcagcccctgatcgtgatacatcgcgagaacggcatctgcatgttgcagatatttcggctgaaacagggtgtctgctggtagtgggccaatgaggtttatcccttgctggcgtagtgtattcagggcaggaataatcgtatcgatctcttcatggcccatatgtcccccttcgccagcatgaggattaagcccacaaacataaatttgtggctgagtaataccaaacttggtttttaggtcgttatcaaggatggtgatcacttcatgtaagctggcttgcgtaatggcacctggcaccgccaataatggcaagtgggtggtcgctaaagccacacgcaactcttccgttgccagcatcatcaccaccctctggcagtggctgcggtcagcaaagaattcggtatgcccaatgaaggggatgccggcatcattgataatacttttttgtaccgggcccgtgaccaatgcagcgaattcaccactgattgcaccatcacaagccttggctaacgtttcaaccacatagtgactgttaccgacatcaagcttgccagggacaacattaacggctgtttttacaggtaaaatagtcagtgaccctgcttgctgtgctattgcaggctgatcagcttggtactcacgcaattgcaggggcagattaagttggctggctcgggccagtagcaaggccggatccgcgcagactaccagctcaacaggccaatcctgttgagccagagcgatggctaaatccggcccgaccccggctggctcgccgggggtgatcactagacgattattgtggttgtgcattactaccatcaagaatttttacataagcagcagcacgctgctcttgcatccaggtttgtgcttcttcagcaaatttacggttgaagagcatacggtacgcccgctctttttgggcggcatccgttttatctacctgacgggtatcgacaagctgaatgaggtgccagccaaaggaagagtgaacaggggcactgatttcaccttttttcagtttcatcaatgcatcacggaaggctggatcgtaaatatcgggtgatgcccaacccagttccccaccttgcatcgctgagccgggatcctgcgaaatttctttggcgatagtcgcgaagctcgtttttccgcttttaatctctgcggcggcggcttccaacttggcgcgagcttgctcgtcggtcatcattggtgaaggcttcaacaggatgtgccgggcgttcacttcagtaacggaaatggtttgatccgccccacgcatgtcattcactttcaaaatatggaacccgacacctgaacggataggaccgacaatctcgcctttatgcgccgattgcagtctctcggcaaacagtgaaggtaactcctgcagtttcccccaacccatttggccgcctttcagagcttgagagtccgctgaattcgcaatagctaatttaccaaaatccgcaccgcctttaatgtcagcaaccaatttgttcgccagatcttcagcttgatcaacttgctgctgagttgggttttctggcaatggaatcaggatgtggctgagattcagttcggtatcaccactgacttgattacccatctgcttagccagagattcaacttcttgcggcaaaatggttatccggcgacggacttcattgttacggacttctgatgtcagcatttctttgcggatttgctcacggtaagtatcgtagctaaggccatcagcggctaaacggctacgcatctgagcgagcgtcatgcggttttgggccgcaatatctgcaatggctttatccagcgcctgatcagtgatggtaatacccattttcttggccatctgcagttggatattatccatgatgaggcgttcaagaatttggtggcgtaatgtcgaatcatccggaacctgctgcccagattgttgtgcgttcatttttaccgattgtagcaggccgtcgatatcactttgtaacacaacaccgttatcaaccaccgcggcaactttatcaacttcttgtggtgctgcgaacgcggtattggcacaaatgaccaatccgagaataagcgttctccagttcttcataccttttccatttatgtaatccgctatcgcgggttaagattcactgtattcagtgtgttaaacagtatcagaatgcactttgataaggcagaatgcccgagttcagcatttgagcagtaccaaggctatgaccaccgctcaaaccacgtaattcgatgttaaagcctattttgttgtcgtacttactggtttggccttgtgcattccagccagttattttgcgttcatagccaaggtttaccgcccaacaacaggtgttgtattgcaagccaactaactggctggcaggttgtttggctttggtatcgtaataatacgccccgacgatcgcccagcggtcagcaattggccaactggccgtggtacctacctgagagatgccttgctggtagtcagggttgtatactttagggacagccgcctgaatatattttgggctcgcgtagcggtaattcaattgaatcatacgatcagcgtctcttctatattccattatagcgttacctaaggtcaaacttcccagccgagtatcatactgtgcgccgcccttcaggcccagttgatcgttgatccgccaaaaagtatcaccagcccaaaccaggctccctgtatcgttactgttatcgatggcttcggtattacctgtgcgtgatcgactgaagtaatagatttgacctacagaaacattaaaacgttcaacccgagcatcatcatatatgcgagaggttaaaccggtagatacctgattagccgatgcaatacggtccaagccactataggtacgatcacggaacagaccagagtaatccgactgcatcaacgtggtgtcatatatatagatatcatcttggttccggtaagggacgtagagatactgtgcgcgaggctccaatgtctgcgtaaagcccgtcgcccagtccattgacctatcgaataccaccttaccatccactttaaactgtggtaggacccggtttactgagtctttcagtttggggttgctagcattgtcagcaaaactggccggaatatcctgttgatagtgggtggccaacagtttggcttctgtatttatgcttccccagctattggataagggcaggttaaccgtaggttcaatatggaaacggctggcttccgggttagttggattgacactggtgaatttggccgcctgaccatagacatgcatatcaaatggaccaacatcgtttttgtagtagttcatgtccaactgtggctgggcacggtaggcattactgttacctgcagcagtaaatacctggaactgcttggaagacagcgtcgcattccagttttcattggcataaccggcggtgaatatttgtgtcgcgtagccatcggttgtcgaaccgtactgagaggttaaatccgtaaagtaagcggggtcgctgacacgggtatagttgatgttgaagcgccaaacttgatccattacaccggaatggccccagtagtatagccagcgggtggcatttttatctgtgccatcaggccccgtatagatacggtcattgggcaaccagtctaatgccatggtgcctgaacccggcgccagcaaatagcggaattcgttttgccattgcaacccgcgcctttccatatagtgtggcgtaatggtggcatcaaagttgggggcaatattccagtaataagggagtaaaaactcaaaaccattgttactggtaaatttcgcatttgggatcaagaaccccgaacggcgtttatcgccaactggcaattgcatataagggctgtaaaacaccgggactttgccaatcttgaaacgagcattccaaacttcaaccacttgttcttcgcggtcatgaatgacctctgagccaaccacgctccaactgttatctccgggtaggcaagaggtaaatgtgccgtttttcaaaatggtgtagcggctctgatcgcgcaatttcatcaaatctgcatcaccacggccctgacggcccaccatctgatatttacctttgtctatatcagtatctttggtgttcagatttgaccaaccttttggtcctttcagcttgatttgcggatcgtcgtagttgacatcgccggtggcggtaacggtacgaaggggaatgacttcaccgggtttctgtacctgtgtcagttccacttggttcgctgttagggtgctattgccttgctgaacaataacattgccagtaaacaaggcattatccggatagtttgcttcggttttatccgcattaatacggaccggcagttgattcggatcgcctgtgaccagtggttgatcataggttgggacaccgagcatacattgctccgcaaggtctgccagtgtgtgttgactatatagtgccgtccaaatcaatgtggccagcagtgttgggaatctttttttcatacgtggttttggtgttccgtcatcggggggcatcatgccggcaaacggtttgagactatatcactcatcacagttgcgctagtgttaaatctggccgtttacacgtctcgccgttaggcgctgagctaaatgccgagtatgataatgcaaattttggctgacggcatggtgaattgaggagtatatgcggtattggggaaaactgctcggtctggtattgggcgtaatgtatgctcctggcgttgttggagcgctattggggctacttgttggccatatggtagacagggcgcttggcgcaaaacgccgcggtttttttgctgatcaacagacacggcaatcactttttttccgtaccacttttcaagtcatggggcatttaaccaaggctaaagggcgtgttacggaggttgatatccaactcgccagccaactaatggataggatgcaattacatggcgctgccagaacagcggcacagcaagcgtttcgtgaagggaaagaaagccactttccgttgcgaaagacgttgcaggaatttcgccgtgtttgttttggccgttttgacttaattcggatatttctggaaattcaattacaggccgcatttgccgatggttccttgcatcctaacgagcgtcaagtgctgtatgtgattgctgaagagttagggatctcccgtggtcaattcgatcaattcctgcgtatgttcgatggggggcgtcaatttggtggtcatggagggtggcaaggccagcaagggggctattcccaaagtggttaccagcgagcgccccagggcccgactctggaagatgcctgtaaagtcttgggggtaaatagcagtgatgacagtgtggccatcaagcgtgcttaccgtaagctaatgggggaacatcacccggataagctggttgccaaggggttacccccagagatgatggaaatggcgaagcaaaaagcgcaggaaattcaggcggcgtatgacttgatcaaacgtgagaaaggatttaagtgacttttttatcgatcagtaagtgactggggtgaacgaaagcagccgatacactggcagtttgaagtatgacgggtattttgaagtatgacggggatatagtgatcggtttcagttgctggagcattgcgctctgactactgaaacctgacccgatctgtgtttagcgtcgctgatgcggtagggcgctgatagagtgagaataaaacctaatctctacatttggtctacgctctacatttggcgctcatttcccgtgcactgcgataccttttgctgcattgctctatctcccgctacacgcaatatcaaaactccatcaaaattccgcttcacatttgaaatgcattggtgtcccaaactctggatgggtaatgcataactgctgtgcatgtagctgcagccgcgatgccatcgctttggcttctggatgggcatagaaaccatcaccgaggatagggtgccccatggctaacatatgaacccgtaattgatgtgaacgccctgtaatgggtgatagcttcactctggtactgccatcgtcatcacgtgagatcacttggtattctgtttgcgcagacttaccggtttcatagcaaactttttgttttggccgattcggccagtcacaaattaagggtaaatcaatcagcccttcatcctgagctaaatggccccaaacccgtgcaatataggtcttcttgggttcacgctcacgaaactggcgcttaagctcacgctcagcggctttggttaatgcaaccacaatcacaccactggtcgccatatctagccgatgcacagactcagcggtgggaaaatcattctgaacacgcgtcatgacgctgtctttattctctggtgcgcggcccggcacggaaagcaacccactgggtttgttgacgaccatgatgtgcttatcttgatacaaaacgatcatatatacccattttcacattgtttatatacccggcatacttcaagtgacatgtgcgttggctgtctttgttcactccagccacttacctgttgttgaccttaaaataaataagcttctagggattccctctgttgccgccttcctgaaacttgaattattttgggtataattcattaaattaatttacttatttagacttttaacgagtcaataaagcttaagcggttactcttgaacgagagtatatcattaaataataaatttttttataggttaaaatgtaagttttaaaatgagttaaaatcagtctgttacatttatatttccgattcattcaagcgataaccaaagagtgataccgtcgatgacctgtacagaatagcattatcgtcagtaataattatttattttggatgctattattgattagaaaaactgtaaatagaatggcctgattaagttaagggaaacggcaaactaatacgttcgagccataggcaatacgcggtatattaaaaaatatttctctttttatttgcctttaggcagtcgagtttgccatgtatttcttgttggatattaacttggttaaaccttattaataagtgcccataattaaatttaaagtgataggtggcctaagttgttattccaaattgcttaaggctgtcattcaactttttaagttattaattaaattaaatgccattccagattataggcagagttaatgtaatgttccatttaatatacttctttatttatagcgaaatgtataatatgtcataccaatttaaacttaattaattcaaacaaaaatgtagccaagagacggggtgatttattgagttgaataatgaattttttaccttttttatagagaagacaaaagcattcactctgagaatcgccatgcagttcgggcgctgaggggctacggggcatttttaatctattgcgatgtgaccttggatagcgaatagcatcagggggcttaatccgataaattttaacgctggcagagagatgagattaaggtgacgttgaatgtatatatttggggtaatagtgtccattaagataatggacactattcgtcagatacgtgtatgaccaaaaacgaggcattggaagattatactattgaaataattaattatatccagtgataatacctcttaatctccagagattttagatcctttgcatgtcagataggacactagaggaagttcaggtagccgtaattaataagtgcattcgccttctttatacgatagcggatttttgctctgacccaactgtcagcagaccattcattttttaccagttccttaccaaaaatttctgaagcgatatcccggtgggagaagccttgttttctgtcatctatggtcttcaagagacctaaatattgctcctctttgcattccacctctattttgtgattaacaatgctctgtaataactcaatatttttagcaaaaacatcagattcaaggttcaaagggatataaatatagaggtttgaatcatcttttaatgcatctgcactctcgataaaaagctgaaaatacccattctgactaaatatttttacgcacagtgtattgtcatgcataagaaggcgttgatgtttgactcctggtaggttggacatatctccccatgtatatccccctttgacatttccagtattactgagtttaactctaactgaacggttacttaattttagtgaccaaaaaacatttgttgggtcagagttataaggatcaatatatttcattactccccattttttttctgcattcaaatccagctctgattggattaattcagaatcatcgggtataccccctccattagtaagagtatttttcataaataattcccaatcgctaatatattgtggatttcgcctcaggcattcccacgcgaagtcattatatagcttctttctcatatctatgtcctcttattttggctattcatccacgtcatcgtgctaatggttatgtaaatttaataaatgtatgaagggtgaaaaaatctgcgaataagtttatccctactactgttttttgtcctaggttatttcttaaataagaaaaaaataaagacataatagctataacctatcacaacagagaatagctataacctataacaggtatgtaaatcaggatgattataaaatatacaaacagggaggttataaatcatgtacttgacttttaaattccacataaggttagcctcaaccagcgaatagcaaggaatagcaagctatttttgattttaaaacggatggacaataatatgagtgacatatttcctcaagcattattcggcgttgaatatgatccggcctatggcgagattgagtccatcctctctcaattagatgagtctgcggaccccctttcccgcccgcatgaaccccctcaaataaactggcaccatatcagtgagcaagccaataagctgctagaacaatgttttgatttacgtgtaatgctttggtttataagggcaaatattcatataaaaggaatctcggccctctatgatggctttatgcgcattaatgcacaaacccaagatactgatgttgttatctaccctcaatcggaagaaccgccattaaatagtgggcatgccgccgcattaggttggttatctacagcacaatgtattgcagagcttaagactgcacgccttacagaagagcacccttacattttacaagatcttattacgactgaagcgttacccaatggccaagagagatattttgttacatcttcgacattatttttaactgtcaataattatttccaacagaatggattgccagatttaaaagaccaattgacaaaagtagatatgttgttggaacaaattgagtcctatgcaaatcaatccacagagagttaccaactgcattgtgaacaattacgtattttcttaaaaaataatatttctcagcttgcacaattgaatgccccagaacatgacgatcccgaaactgtttatcaaaaaatagacagtcatgaatctcttgatactcagtcctttaattcaaatgataagagcattcgctcacggcaagagatcattatgatgctggaccgtattctagagtactttcaacattatgagcctagtcatccagccccaatattcattcgccgtaccaaagagatgataggtatggatttttattccattgttgaagaaattctgcctgaagctgtaattacattaaaacagtttaccggaaaaactaacctaccgtttcgatgaggatatttaaatggccaaagatgcgagctcgcaaaaatttatcggtagaaataatgcacctagagtgcaaattgaatatgacgtcgaaatttatggttcaaataagaaagtagagttgccttttgtaaccggcgtgatggctgatctttctggccacagagcaaagcctcttcccgccgttgaagatcgtaaattccttactttcgatcaggataatttcgatgcccggatgagagcaattaagcctcgccttaaattctacgtagataacaccttgagtgaggataacgaactcctggatatcgaactggattttgagtcaatggatgacttttctcccggatcgttagcgcggcgtattcctcaaatggaaaaactgcttgaggcacgtacccatctggctgaattgatcacctatatggatggtaaaaccagcgcagaagaggtggttaaacaactgcttgaacaacctgattttttacaaaatcttgcgaccgatgcacagggaactatttcgaagctcagccaggatgatgatgttttagtggaagatgacgatggagaaaaatagtggagaacatgcagaaagcccaactcaatgacacgccagacatcaacgtcgatctggctgaaaacgagttagatgacattttaaaacgttcttttcgccctcgaactgacgaagcttccgccacagtgcgccgtgccataggcacgcttgctgcgtatgccaataaaggccaagtgaaagtcaatcgtgatgtcgtactgaccattgagtctttagtcgctgaaattgacgaaaaactttccgatcaaatgaaccttattctgcaccataaagagttccaaaagctggaatcagcttggcgcgggcttagctatcttgttgataatacagatgctaatgaaactttaaaaatacgggtactgaacattagccaagatgaactggggaaaacgcttcgccgttatcgtggctctgcatgggatcaaagtccgatatttaaacaggtctatgaacatgaatatgggcagtttggtggggaaccttttggttgcatgatcggtgattatgaattcgatcacagtccacagagtgtggctctgctgaccgagttagccaaggtggccgccgccgctcactgtcctttcattacctcttcttccccaagcatcatgcagatgaataactggagggagctgggtaacccaagggatatcggcaaaatttttaccacacctgaatatgcgccatggagacgtttacgtgagagtaatgactcccgctatctggtactgactctgccacgttttctttcgcgtctgccgtatggtgccaaaaatcatcctattgatgattttgcttttgaagaagtggttagccctcatgccagtgaggatttcacttgggcgaatgcggcctatgccatgggcgtcaatattaaccgggccttcaatgaatatggttggtgttcaaggatccgcggtattgagtcgggggggtccgtagaagaacttccggcctatgcttttccttctgacgaaggcggatatgaactcacttgtccgacagaattggcaatttcggaccgtcgtgagaacgagctatccaatgctgggtttttaccgctggtctaccgtaagaactcagactttgccgcctttatcgggtcgtgcaccctgcatgcaccggcaaactatgatgaccccgatgcgacggcgaacgccagattatcggcccgtttaccttacatttttgccacctgtcgtttcgcccattacctcaaatgtattgtgcgcgacaaaattggttcgttccgctcgcgggatgacatgcaactttggcttaacgactgggtgatgaactacgtcgatggtgacccctccatttcaacagaagccactaaagctaaacgcccgctggccgctgcggaagttcaagttgaagacgtagaggatgatcctggtttttaccgcgctcacttctatttacgccctcactaccaacttgaaggtatgacggtttctctgcggctggtttctaaacttccatccaacaaggaaagcgaaaagaaataagcgctgtgaatatcactcgcttattagagggggaatataaacataaatatcaaggaggtaaggccaaaattaaataggaaagtacatttttaatgaggcaactttgagttgccgaatactgatttaacccaactttaatgacattaattcaggagtgaaaaaatggcagctttagtcgattactttctccatatcgaaggtgtagatggtgagtctcccgatcagcagtataacggatggatccaagtacaggcttggcaatgggcggaggagaatgcggggcgctgggggctaggtggtggtggtggttctgggaaagtcgaaatgaaggacttcgaatttcgcatggtgagtaacaaagcatcaccaaaactatttttgatgtgtgccatcggtgaacacattccgcaggccaagttggtgtgtcgtaaatcaggtcaaggtcaacaagacttcctgattgttaccttcagtaactgtctggtgtcctcctttaaaactgtcggcaacatgcctcttggtaaaggggacgcagtattcaccgacactgtgctgccaacggatgccatcagccttaactttgcacgtatcgaagtggaatacaaagagcagcaacctgatggctcgatgggggccgtgattaaggctggttacgatctgaaattgaacagccgtatttaagtcagaaatgcattaagactgctctcgcgagttaggagagcagtcttccaaactggattggggagggctaattatggatatttcagcaccgatactttttgacaaattaagtctccgccatgaacacgttcgcttacctcattggcgtgaagtgattgtgcgcgatattgaatctttattgaatgactccgcacacagtgcccggttgaagctaaaaaagtatccgcattgtgaggcttccgtattgaattacggcctgccttcgctcagccagcaggttccggtaatcaccgacttgctggaactggccagacatatacagcggatcatcgccacgtttgagtcacgcctggatccgcgctcaataaaagtggtgccgctgattaataaaggcgaaacctgggtgttagccatcctgtttgacattcatgcccggtgcaacctaccgggcgaagagcacttggtcaatttacgcatcgcgctcgattactcctatggaatggttcgcgttctttaaataacgcgcagagataaaacagggaaaccgtcatgcccaacgaaagttttctggctctatacaacgaagagttgcgttatctgcgtgaagatgggcagcgcttcgctcatatgcatccgcaagtcgcccaacaccttgggttacatgctgatggtgtgctcgatcctttcgtcgaacggctccttgaaggcaccgctttcttgagttcccgtatccaacagcgtttgaacaacgagcatccagagtttgctttgcaaatgcttgggcgtttggccccactttggtatacacccctgccgtcgattgccaccattgccatggttccggatcttacgtcaccgcaatggcactcgcgcgtcgtattgcctaaaggtagccgcgtgacattgagtgacagttcgctgaacaaccggttggcgaatttctctactggccgcacgctgaaaatacagccattggtcattgaaaatgccgagtgtgccagcacgccaccggcgtatttaccgctctctgtggcttcacaattacaagctggtcaggcccatctgcgcttgcgtctgaccactcaaggtgtcgcgtctttatctgagctggatttcgccccgatgaacctgacgctggcggggggaataattcagtcaaatcagttaatcacgacactgttgaataacaccttacatattgttttgtgggccaacacggatgggaaaccgctggtcaaagttcttaccaaagaacatcttcgccagggagggctggatgaacaagaggcgcttttacctgttgcgatcagcgaaatgcctggaaaccgtttgctacgagaatattttgctgctccttcgcgttttttcgatctggaactgcatggcctcaacgacttcctgcaacaaggggacggcattcatacctttgaggtgctgtttgtactggatcagcgccccctacatttgattgatagggtcactggcaatgacttccgactcttcgccacacctattattaacctgttcaaacgccgttgtagcccggtgctaattaatggtgaacacaccgaatatcccgtcattgttgaccccctgaacccccgcttgtacgaagtccatcatgtactcggggtcaacggtttgttgagcgaaggggggagcgtgcagttttcttcccttcatggtcatgcccgttttgatgatgacgataaagtggcgggttacagcattcgccgtcgccgcgacttcacggataaaaatcatcagaaaaattcacctttacctcatgacagcttattcattgccctttcaccggggaccagcgggatagatattgatcacgtcaagtcgctgtcgattgaagccatggtgtgcgaacgccacttaattcccagccaattacagcatccggaattcaagctggaaattgccctgccagtggggcagatcgaaatgctgcgtcacccggcaaaaccacagggtgtgccgaatattgatcaagcctggcgggcgttacaactgattgccaacaatccgctgcgttatgcgctgccggatgtcaccgattgttcgccgctgctaaaagattggctgtcgatattttgtcagcatgaagaggcgagccagcataagaggatcactagcctgactcacgccagtgtggcgcataattttgaacgtcataccgctccggggccgatcgcctggagccggggggttgaagccacactggatttcaacagcagccaccacagtgataaaggtgcattcctctttgcgcggatcctgcatcacgcgctgtcagaatattgtgaattagggcagaccctgaggttacacatgcaggttgatggtgaaaccttcgccaaatgggggcctgtcaactatggctagcctccagacgctgaaaaacacgtttctgccgggtatctcggccagtcaggactttttcgagttgctgcgtcggattgagcgtgccactccagagcaaggccggcttggcacccaacgtgatcgtagccatctgcggctacgtattattcagcctgccgatatgggatttgcaccgcgtgaagtgagtgatatcaggcaaacgctgaacactcatcagcatctggcagagatcaccattttctgccgccattttggtttatttgccccgtatggcccgttgccaatacatgttaccgaacatgctcgtaacgaagcgttggctaaacgtaatcaggcctttgaacattttgcgggcattctcagccagcgaatggcgatcttgcattatcgctcttgggcccaaatgcacgtcgccgtggggcatgatcgcgcgtcagccaatccctttatgaaccatgtgcgtcaaatcgcgggcctaacgccgcagcaagcgctgaattcacatgtggatcgggtacggcgttgctttccgggggtgtatctgccgggcagaggatcattacgcaaattacaggagatcctgagcctgtatttctcggttcctatccgtgttgaagcccgtaaaggattgtggattgacgactcgcgcaatatagaaagccaacgtatgggacggttgggtaacacgcgtattggcagccgtttcttcgatgtgcagcacagcctggtgttatctattggtccggtatctgacccccaatatctggattttcaacgcaacagcaaacgcattaacactctggtgcaaatctgccatgactttgtccgccatcggatggtgctggacgtgcaattaatcatacagacctcacccaatatggcttgtcgtcttggcggtggaacgctcagccgccatagctggttaaagccaggctcagccttgagtatacagccaatttatagaacggttacctagctatgggagcgataacggtgtatcaacgcgaacgtctttttaatcgattgggcacttttgcctataaaacttttgttgaagccacccgtctttgccgcagttatcggcatgagtatgtggagcttgaacattggttaaaaattctcatggatcaacagcgtggggacattcctgctctactgacgcattacggactgagccaaacggttatctccacgcaattggatcgcattattcagcatatgcccgtcaccaaagcatcggtgcaggatttatcatcacgcttggagtccgtggtcgaaggcggattggtgttgagccaattgatggcgtcaccttctcctatccgtacctcacatattttactggcactattacaggatacccagcatcagcgctggttataccgcctgtgcgatgaattcaaaaagctgccggtcccacaggttgcagaggaatatgaaggcctattagttaactccattgaacagaccagcgaggttcaaagaggcgacgcattagtgacggaaacggacagcagctcatcaaaagaagcgcatgcggcattgaacaaatggtgtaacgaccttacccagcaagcccgtgacggtgagattgaccccgttattggtcgtgaagcagaactgcgtcaagtgattgatattttactccgtcgccgtcagaacaaccctattttggttggggaagcgggggtcggtaaaacggcggtggttgaagcgctagcgcgaaaactggccagtggcgatgtccctccgctgttgcaaggggcgcgtctgctttctctggatttggggaggatgcaagccggtgccagtatgcgcggtgaatttgaatcacgtcttaaatccctgatcgatggcatcagccaatcggataccccggttattctgttttgtgatgaagcccatacgttggtgggggcaggcgggcaggcgggcacgggggatgcggtcaacctgcttaaaccgatgttggcgaggggcgcattgcgcatgatcgccgccaccacctggtcagagtataaacagtttattgaacctgacgccgcgctgacccggcgtttccagcgggtattgattggcgagccaaacgaatctaccgccgtcgatatgctacgggcgattgcgccacattttgctcaacatcataacgtcactatccgcgacggtgccattcacgcggcggtgcgcctgtcattacgcaacctgccttcccggcagttgcccgataaagccatcagtctgctcgacaccgcttgcgcgcgggtcgcgctcagccaatatgcccaaccacaggcgattgaacagttatcggcccaactggatgtgcttaaaaccgagcatcaatatctggtacgggagaagcaactgggcgaagcggttgatcaacggctagatgacgttcagacacagatccaagcgtttgaacatgaactaaccgccttgcaaagccgccatctgcatgagcaacagctagtgagggaggtcctgccggagggagaaggcagtggcatgatgacggaaaatgcccgctggggtgaactgatggcgttacaggaagcgtcgccactggtctatccatgggttgatgagcagagcatcgccgcggtgctttccgattggaccgggatcccgtccggcaaaatgttgcaggacgatattgaatgcgtcctgaatcttgaacagcgtctcggtgatcatattttcgggcaacgcaacgctatcaaagagatttcgcaggcgatacgtattgctcgggcgggcatccagtctcaggagcggccactcgggatcttcctgctggcggggtcaaccggtacgggcaaaacagaaacggccaatgtactggtcgaaaccttgtatggcggtgctcataaccttattaccttcaatatgagtgagttccaagaggcgcataccttatccacgctgaaaggcgcacctccgggctatgtcggctatggcaagggggggaaattaaccgaagcggtaagacgcaaaccttattcggtcatcctgcttgatgagtttgataaagctcacgccgatattcaggacgccttttatcaggtcttcgacaaagggtggatggaagatgccgaagggcgtcgggtcagtttccgccagtgtttcatcttactgacctgtaatcagggcgcggaagagatcgaacaggcttacctcaccgccaacgatatcaaacccggtgcattaaaaccgttggtatacgacgccctgttgcgccgctttgcgccagcgctgttagccagggtcaatatcattccttatatcccattagatcaggacgctctggcacagatcgcctctcatcatcttgcgcgcttacaaacgcgcctgtgggatgaaattggtgccactttggtgaccgagggggatatccccggctggatcgcctcacgggtttgcagccatccgaaccatggtcgtgcggtggaagaactcttgcgtcaaaccttacttcccgctgttggcaatgaagtgttgaagcgtcgccatgaggctgaaccgctgagagagatacgcctgattgttgaggagacagaactgagtattgagttcgcgtagctgatgtttagtcgacaacggttgttgagctgaacgctgtcgttgggctgacaactgacgtttgggctgacgtgagtacacatttattttaaacggggccgttatgcaattaattgagatagagaatgaggttttatcgggccaggatgcttttcctctctccttcaagacgcaggaaaaagtgtcagggaatccatcctaccaactggtatttcaggtagcagaagcggacctcgatctggtcagtttgctgggggaaatcatcaaagtcaggattgagttacctgactcagccggctaccggaccttttttacctatgtgatcgccggtgctgatgaagggcaacggcaagacaaatttgtttacagcctggaactgagtacctggacgtggtttttgatgcaaaaccgcaactgccggatatttcaggacctgaatattatcgatattatcgaacaggtattctccaaatataactttgcggattaccgttttgatatcgtcggtaactatcggttacgcgagtactgcgtacagtttgcagaaaccgatttcgactttgttaatcgtctgatggaagacgaaggcgtttggtattacttcgaacataacgaagataagcacacgctggtcatgacagatcagcaacaattccctgtattggaagggcattatgcagaactgagtttcctgcctgacagtgaagagatgcgcgccatccgtgaggggatacagcgtattcaacgctcacaacgcatccactccagcgaaattgtcttacgtgacttcgatttccttaatccacgcaatacattacaaacccatatcgaagaaagccgccaacacctgcaaggcgtaccactggaatggtatgactacgcggcgggttacaccgatccccagcatggtgagagcatcgcccgtttacgccttgaagctatacagagtaatgggcagctcttgtctggtgaaagtaatgccacaggattagtgccagggcgctcttttgctctggtacagcaccctgataacaaccgtaatcggggattcaaactgatcagttgtgactacagttttgtccaggatgggccggacagtgcgagccagggacgcaatgtcgcctgtaagtttaaggcattgaatgatgacgtcgtttatcgtccacaatgtgtcacgccaccgccaaaggtccctggtgtgcaaagtgccacagtggtcggtgcgcgtgaatcagaagtgcataccgataagttcgcccgtattcgcgttcactttcactgggatcgttataaaaccaccgaagatgatagctcctgctggatccgcgttgtacaggcgtgggccggtaaaggctggggcgtcctggcgatgcctcgggtcgggcaagaagtgctggtcaattacgttgacggcgaccttgatcgcccgatggtgaccgggatcgtctacaacggtgagaacccaccgccttaccgtttacctgaccacattaactactccggttttgtctcacgctcactgcgctttggtcagccacaacacgccagccagcttaccttcgatgataatcggggcaatgagcggatcatgctacatgctgagcgcgacttacaaagaacggttgaacgtaacagtgcgacggccgtcggtcaggataaatacgacacggtggaacggacggccacggagtggatcaacaaccatatctcctacaaagacttcagtttctcggtgacgggcatgagtgtctccgcgacgggcatcagtgtctcgacaacgggaacgagcttatctgtcaccggcatgagcaccagcgtcacgggtgtcagtgtgggtttcaccttgatagatacctcctttacgggtgtgagcacatcgtttaccggtgtcggtacctccttcaccggggccagcaactcgctaaccggtgtcagcaactcgatgactgggtgtagttcctcgtttaccggtactagcaatagcatgacaggcagtagccatagcatgaccggcatgagcaccagcatcaccgggcatagcatgagtcagacgggttccagtagcagcatcaccggtgacagtacctcctttaccggcagcagcgtcagcagtacgggcagcagcgtcagtacgaccggtgtcagtaccagcactacggggagtagcacctcgactaccggttgtagcgtcagtactacggggagcagcacctcgactaccggtaattcagtcagcatgaccggtaacagcaccagtaccacgggatgcagtatttccacgacgggcagcagtattgggacggtaggaagcagtatcagcaccacgggcagtagcgtcagtaccaccggtagcagtatcagcaccacgggattatccgtcagttataccggcgctcaatattccgatgtgggtgtcgatctgaaaaccgttggcatgcaaagcaaaaactgaaaaggaagcattatgcgcatcattcgcccgcaacagctcgtggtcttgaaaagcagttaccagataggccatgaaagccatatggggatcagcgtcgttgctggctgttatctctctaaacctgagcatatggtgacggagtcacagatctggcaggcatggaaagcggcaccgctctctttccgcatgttggacagtgctgagccaaaaccctttgctgagtttttgctggccggtcatgccggtattggtgaagaggttacctcgctgagtgcagaggttagtgttggctcactgacccggcgctggtgtattgagggcgaaagcaacaaaacgggtctggtcattaaacctttcttacgtatgtcgatggaccatacgcaaagttgggggggcaaaggctgtaaggagaatccactgggacgtgggtataacgatgagcgcaaaccgacgattatgtctttaggccttgacggctctgctatcgttcgctcaccgctggcgtctccgtcacctgtgcctcatgacttccaactgcgtaaagtgcatatcaatgaagtcgcctcgaccatgaccgatcctcaatatctggaaacattttatcccggtttgccaccgcaaattgatcgtcgctatttccaaatggctccgccagggcagtggctgaagaaaagtgcatggcctgatagcgtaccgttcaaactcatcggttttcgcccggacaatgaggagatcagcggtgcgtttcctgcggtcagtgcaagggcgtttgtttgggataacccttcagcgcctcccagtgaggtgaccttactgcggaaaacactgtggctgttaccggataacgatatggggctaatggtgtttaccggcagcgtgccactgactcacctttttgatgagcctatcgatacgttgctggtgggattggatgactcccattcgctacgtgagttggaatattaccaacaggtctataaaagtcgcagcgttgaaggtgctgcgagttttgaattcctcaaagatccggaactgatgccagaggggatgccgctgaacgtcatccgggatttggcggatcacccagactcgctgcgttatagcgcttccgccatgtctgaagcggagtccgaacgtttctatcaggatgttcaggatgctatcgatcggcaggaacagcagaagagtgaagaacaagagacgctgggtgatttgaacgtccccgcagccggtaaagaggaagcgggaacccaatggttggaaagcaaagaagatacggcaaccaacgtcacatttttagggactgacttctctggaatgaccttggacaacaagcaattccgctattgcatgtttaccggttgccattttgacaaggcgacatttaaagactgcaccttcgagcattgccagtttacgcaaagtgattttgaaaactcccgttggaacaatgtgcatttaagtggctgtttattcaaacaggcagagtggcaaaaagccgcctttacccactgtaaatgggagaaatccacctttgagtatggggtgtttaaacacgctcagtttaccgacaatgcgttagataactgcctgattaaccatagtgatttcagccttggcacgtttgatcattgtacgctgaatggctgtttcttctccgaaacacattgtgatcaaacacaatttaatcaggtcatcatcacgtcgtgcatattcgaaaaatgcgacggcccgaaggcttgctttaccgaaagcacgatagagaaaacctcgtttattagcagcagttgggtaggggtgcgcttgagtcattgctatctcaatagcttgaccacgggcctgaataccaatctctctgagtcgcattttgagcagtgcagcctgaataaaatgggcttcctcaaggtcaatttacaatccagtacctttattaattgctcgatgttggagagttgctgcgataaggctgatttctctcaggcgacgctgattgcctgtgatatgaccgcggtacggttaaaagatgccaacttagtccatagccactggcagaacaccagcttacagcaaagcatgttttacaacgctgacttacgtgatgccactttccagcgttgcaatctggcgggcgctaatctggcgatgatcagccaaaacatggacacccgatttgaacattgtttgacggaaaagacgcactggatcccgcgtcgttacaccgtcccggcataaatatcacgtttcaaaggagcatggaatgacaccgtccgacacccctattatgcctcccgacagtccacgtcggattattggcaggcactttacacagcgtcagttgcagcagttaacgctgtctgaggtttattttattcaatgcaccttcacggatatttcgtttgccgagattgcggtacgcaatattcattttgaaagttgtcattttactcacctgcggctggacggtggcagagtggaaaactgcagtttccgtttctgtaagttcaatgacgtttcagcgcaaggcgtttccatactcaatacctcatgtatagaggtgcaatggcagggatgctatctcacggggtgcttaattgagcgctggttgctcaccagttgtcagctcgatgatgcccaattgcaggatatccagcttaattattggaccgtgcaagacaccccgatgactcatctgacgatgagtgacagcaaaatgcaagattccagttggcatggctgcactatccagcagtcagtgtggaaaaacagcgaactcatacgtcaggtgatgggcagttgtgtactgaaagagtgccaatatcaagcgattcaaagcgatacggtggtatggagtcagtgccagcttgagcaggttgattttcggcaccagccgctggaaaacagtaatttccacaaaagcacactaacacagtgcgggttcagtgacgctaatttggccgccgcgctgttcagtgaagcgacactcgagggctgtgacttcaacatggcgcaattagcggcggcgcagtttgttgatgccacattgcgcgattgcaattttgacaccgccgatttgcaaaacgcctctttgctacgggccaatctgacgcgatgtcacttaacgcaggtcaatttaaccaaagctgatttgcgcagttgcatgttgagcgagtcgtcattacaggccagtaaacttagcaaaacccgtatccacggcgcgcaaatacccacgctggacacaccgctacaaatgccggatcccttgctgagccagattgataactggtatggccatcatcaacccggtccaaaaaataaccctaaattcccttcgataccttcaggagccagccgctatgtctagattaaccacgttgctaaaaccgaaaaattcgttacccggctatctgtcttattcgccacggacgccgttgcccgccgtatccgctccgccgcaggtgatcactgcgaaggttatccggccgggtaacgccagcgtatcactgctcgggtatgaaacactgcccgtcaccacggcgtccagttgtttattccagccagaaaacggtgatctggtcagtgccgttattgaccagcagcagatctacattacggccattttataccgcaccagccctgacgctccgttggtgatgaacagtggtgaggtgcctttgcaccttgttaccacggcattggaaattcacagcccggatcgggttgagatccacacgcgtcatttttcattactgacccgtaccaccctatgggtggctaaaacgatgcatcaggttgctgactctctattcgtgagagccaaacaagcgagtcgagaagttgaaaataccgacgatgtacatgcccgacacattagtcagttagcggatcaaagcttaatgattaatagccgtatcggatcattaaatgcctctgccgtgctcaaaatcgacggcggacaggttcatatggggtaatcacgatgacagcagccaatactcgcgcaggtgggatcagctttatcggcagtgacccgatgatcccgatatctgctcccaacaccgcgcccaacgccaatggtattcctaatgtcagcaactatttttgctgtgggggtaacgaacagaatctcaacaccatccgtccagccacgatagacggcggatctgtgatgggggcggcctcggggacacattcggccaagatggaccctatgcagggatcaggaaagtatttcattcagggaagcccagcaacacgtttaggagatatgagtatgaccaataattacaacgcgccttcgacgcaaattgcgcccagccagaccaagtattttgtcaatgcgtagcctctttcgtgtgttgcctatttttatcctgacaggttgcgtcctgctcagcggctgtagctggttttcctcatcctcagaagcggcgctacagaaacggcggattgacttgcaggttgttgcggctcctctcatcaatcctgggcccaacggtcaggcacagcccttgaaggtatgcattattgagctgaataaagaggggtggtcaccccccggtttgtatcaggggacgctctgcagtggcatcagtgtaggaggtgaagtcgtcagcgtgacggaatacatccttgcgccgacagaggtgcgtcaatattcccgcgatgttccctttgaacaagagcgctggtgggcaatagcggctgagtttcaggagatgagtaacggtaaaagcctattaatgctgaaatctgatgcccgtgcggacttcaaccgtgtggtgctcgttgatggtaaggccctgtcattaaaagcgtcaacaaagtaggtcatcaagagcgtcaacagactggcaagtgtcaatagactggcaagtgtcaacagactggaaagcgtcaatagactaaaaagtttcaacagactaaaaagttgcaaaggactcataatatgctgccaaaacaacgtgttgcttgggtggaagggatgctgatggaaccccagcattttcaacaacaggaacgatatctagaacatttaactgaaatgcgggcacgtagcctcagcgcgctggcatggggcttccatagcctaagtatcaatcaagggctgctggatcagggcaagatcgccctcaatcaggccagtggtgttttccctgacggtacaccttttcatatggcgggtgatgagccattaccgctaccttttgatccgggggagaactgccaaggcagtgtcgtgtgcctttcggtcctgatggatatacccggcaatacctatattgatctgaagaagagcaaccaaggtagccgtttcgttgcgctggatgctgaagttcaagacagaaaccatggcgtcgctgctgaaggaacgccattgatcgccacccttcaactggggcaattgcaatccaagctcaccttacgtgccagcgtcagtgatgcagaatcgatgctgcccgtagcctatatcaaagagcgcacccgcgatgggcgtctgattctggatgataacttcctgccacccatgttggattttcgcgccatagggtggatcgataatgcggtaaccgaattgctagggttgatcgttcagcgactggaatcggtttaccggccagatgtgacgctctcagtcggtgggttatcggagttactggaactgctattactgcaaacactcagtgaatataacctaaagatttcacatgtgttgatgcaaaaacaggtacaccctgagcagttgttccaattattgcttgggttgttggggcgtctcagtactatccctggcggagaaaaaccgtggtcgaggcaggatctgctctatacgcatcatgaaccgcacaacgggtatttctcgctgtttgccgccttacggcgcgcactctcactggtgatcgaagcaccggcagtggcgctaccgtttatcgaacgtggcgacaatatttacctgtgccagaacgattcacaactgcgcctggaaaaactgatcttcaccgtcagttccaaactgccttccgagaccattcgcacttacttcccggcgcaaaccaaactggggccggtggagaaaattgtacagttgatcgacctgcaattgcctggcgcacggatgatcccgatgtcatcaccgccaagatatattccttattacccgaatagcgtctatttcgaagttgaccatgatgatcctatgtataaagaaatgatgtctggttcagctatcgcactcagcatcgtgggtgatttccctgagttgcgttttgaagtatggggcttgcgacaaggaaggctcggatgaacgaatttgaacgccagatccgtgcagccatttccgcagcacgcaatggcgcaaaacatgcggaacagtcactgactacaccaatgtggcaagccaaaagcaccgtagcctcattgggtgggattgtccctagaagtggctcttcgtcaacgtcacaggcggagaactataaggaagatctcgcggaccaggctgcctcgggcaacaacatggcgcgcacgagtgcgccaccggtcactttgtatcagcaacagccaaatgcgaatgacagctatccaaacgggaataacaacaatccaaacggggataacaacaatccaaacgggagtaacaacaatatagcgagagtacagcgtatgccgcatggcatttccaggggcttatatgagcgccctgggatgttattgggtgcctgggataacgcctatattgctgcggctatgcctttgctgctgctggtggaaaatattcgtagctggccgacgcgtaacgccgcagaggtcaggccaccgattgtgcgggaattacaatatttccagcaacatttgcagaaaaagaactacccgcaagaagacattaaccacctgtcttacctgctatgtacctatatcgatggcatttttaacgggctgcaaaccccagactcctacaaccaaagtctgttagtggagtttcaccgtgatgcctgggggggtgaggactgcttcgaacatctgcgggtctatatgaactcgccgaaacagtaccgggaagttctggaattctatgatctgattatgtgccttggttttgacggtaaataccagatgatagagcatggtgcggttctgctgatggatttacgcagccgtctccacacgcaactctacggccaggacgccacacaatctttggctatcgcgcaagcggtcaaaggttctccgcgtcgccaatatatcaaggcgctgaaaatcttcacctatggtttcgcactgtgcctttgtgcttacggcgtcacggcgtggtatctgcaccagcaatcccaacagatccgcagcaacattctgacgtgggtactgcctgaaccgcggaaaatcaacatcatggagaccttgccgaatccgctatccaacatcctgaatgaagggtggctggaggtcaggaaagatccgcgtggatggctattaatcttcacctccgacggcgcgttccgcacgggtgaagcgaccctctcggaagagtttatcaacaagaagaatatcgaacgtcttgggctggcattagccccatggccgggagatatcgaggttattggtcatacggataacaaaccgttccgtagcacttccggtaacaacaacctcaaactttccgcggccagagcatcggtggtggcagataaactgcgggaatccactcaaatcaacgaaacccatcagcgagaaataagtgccatcggacggggggagagcgatcctttagctgacaatgcaacggaagaagggcgcaagcgtaaccggcgtgtggatatcctatggaaaattggtcagcgcgatgccgataaggccatgaagcaattcctggagaacccaacaccagaagttcaaggaacgaatacccaacaataggaattgctatgatacgcagaatgttgattttaatcattgccctagtgctttgttatattgtgtggtggatagggccgctgatcgccattggcccctatttccctctggggggggtatgggttcgtaagatcattattgctctgattttattttgggcactgtggccatttgttgcaattttcttcagttggatttttcgttatgcccgtgcgccacttcccaagcgcaagaaaaaaacggttcagcttgatcgcgtttctgcacgttttcatgatgcgatgctcaccctgcaacatgcggatctttcaagccagaaaacacgctggcagcgctggcgtcaacggcgtaagcgccagtatatcgatgctaaaccgtggtttctggtcatggggccacccggatgcggtaaaacgtcgatagtttatgagagtagcgagaagttcctactctcagaacagtatggtttagcgcagaccacggatattggaccgacgcaggactgtaattggtggctgacggatcgtgctgtttacatcgatacggcaggggaatggatcctgctgcatggtcagagcgaagaagcgggcacggctcggcaaaaattgttctctatgatccgcaaatatcgccgttatccgggggttgatgggattgttctttgccttgacgtcagcgtgcttttgaactcttcggtgacggaacgtaagtcactggctgatacgttgcgcctgcggatcctggaagttgcctcgacatttcaggccgatattgcggtgtacttgttcctcaacaatatcgataagttacctggcggcgaaaccttcctctcgctaatgaacgacgaacttctggccggagggcttgggattagcatgacccataatgaaaagggtcagaacaatttcgttgccgatgaagaacgttaccgtgaactcctgacacgtgttagccgttatgtgttggaaatattgcacgattcgcccaatatggagatgcgccaccaattgctgctgtttacagaaagcctgggagcgctacaaaaacccctgtttggcttattcgaacaaatatttccggcgacaccgattggctataccggttgtttgcggcagttctggtttggcagtacccaaaatctgacctcatgggaggcgctgtattatccgtcatcgaccagcacctttgaaagccggcctgctgggcagatgtatttccctgcactgagtcaagcgatcaccgaaaggggggtattacacgccaccggcccaatgcctctgcgaaatcgcctgttaaacatcggtaagtatgtgttcgtggtccttgtgctctgcatcttattgttgatgctgagcgcccgctatttttgggaatatgactatattggctatgcgacagctcggtttgaggaaacccgtcggattgtgcgtgacatcccaatcacgaatcaggtcaacgataatctggtcgcagcttacgaacagttggggtatatcaacacccattatctggaaagttcaccgccactgctgacaccgtacttcgagcaccgtttactgaatcaggcgatgttgcaaacctaccatcgtcacctgaataaagtgttctggcctgcggtacaaaactacgtcaccaacgagctgaaaaaggacactcaatctcctgacggtgacaactatgacacgctgaaagtttacctgatgctcggacaacctgatcaccgctctcaggaggcattggtgcaatggtttatgtcgcgctgggaaagttttgcgcctcagggatatgggcaaaacgaccgcaaactcttcagttatcatttgagtgaactgttttctgacaccgcctcagctgccccgaaagttaagctgaatgatgagctgatccgtgaatcacgcattaaagcgatgaaaacaccgatacacatccgggtgattaatcgtattcatgacgccccactgcccgcgaggattgaggatcttagtctggctgatgccgccggtcctagcgtaacactgatgctgagacgtaaaagccccagtacagtaacggatttggcgatcccggctttctacactcgggccagctaccacgatgtggttaacccacaacttcaggaagcatcggaagcgatgattaacgaggaagcgtgggtgttgagtgacggtaaagcttcggttagtcaggttagtttactggctgctgcgcaaaaactgtccgatgaagcgcgcaagtattatctgatggagtatgccaaccaatgggatgcattcttcaatgatatcagggtgcgcccaatcaacggacttgatgatgcggcgctgctggcaaggcaactctcagacccgtcatccccgttggctaatctggtgcgtttctccacacgtgaaataaccctgaccactgacaacaatggtaaaggggcgatgtcgtcaggctggttcaatattcaacgtaataagctcacgactgcccgccgtaacatcattgacgaaatgtcgggtgagcgttctcgttttcgtctaacgccagagaaagcggtggaggatcgctttgaactattaagacgtctgggatatgccctgcaaagtgcgtctaccagcaattctgatccgttgggccgaaccttcgagcagatttataaccagttgataacactctcgacttcccttcgggctgggcagattttgccgcaaaataacgatttcagtcgcttgcaaatcgatatggcccgtcagccagagccggtgcgcagcattatgatggatctgctggccgtcggacaaacgcaaagtctgcaacaaagtaaggccaacctcagcaagggcgtctcttcaattgcttctgatttatgtagcaacgccgtcagtggccgttatccctttaatcggttggctagcgaagagataggtattggcgatttcaaccgtatgtttggtcgttctggggcgatgcaaagcttctttgatcagaatctcgcaccgtatgtcgataccaacggcaaccgctggaaggtaaaacctgacagtaacggtgtggtgacccctaaaactctgcgttcgtttgaaaactcagcacaaatccgcgacaccttctttgatgcctccggcaagatggcgatgtcgatgatcattcgccctatctcactgactccatcaattttggaagcggttcttgatgtcgatggccagattattaactacagccatggttctaaccaaccggtaaaagttgattggccaggaccgaaaggtggggtgtatatccgcctgacgttcaaaactcaggatggaaatgtggaaaccgttagcttcaatggtccgtgggctattttccgcatgtatgacgttagtaaccctaggccactcggggtcaatagccgtgaactcatgatggtgatggataacgtgagtggcgtcttcaaaattgagttgagttccaccatgaaagattatccgctgtggtcaaaagcattggcacagttctcatgtcctaagaatctctaaccgcgaaataaggaaatgcaaatgctagatcctaaaaacatccagaatgtattgaagtcatctactgaccttggtcagcaatctcaatctgatttgcagaaaccttttgtaaaaggaatgcaaaatatggagatgtcaggggccgatgccgctcgcagtatcatgcaatcggttaatcaatcctgcgaaaccatgatgagcgatatgaataagatattgggaggattgcaggacaatgttgatgctcaccagaaaatgcaaagtgaggagcgtccgaaggacttcgagagagccatgagtgatcttcgcagcacactctccaatggtttcccagaggaaatgaaaagtatgtttgataaattgcccaaaatgtagcgggcagtcgtcagacaaaaaaatatccgggggaatgccccggatatcagactgctgacaaaccccgatgactcactcttgaacggtgaggataggcagaggagtaaagcgtccgcgccagggagggcgcggctcgagcctacatggatgtatttacggcgtctttacgatctgcctgttctctccgtcgcgggcactttgtcaataacctcggatattttcattgatgccaaagaacgactttatttcaaagaactactgatgtgttaccaccaccagccggatagcatctaaacgccagcctgcttgattcaggttttccagcaccatcttacggttatgctcaagcgcctctatttcgtcatcacgaatattcgggttaaccgctttcaacgcttccagacgcgccagttcagtactcaacttatcatcggcctcgcgttttgccgtttcaatcagagcctgcgcttgcgcttctaccagtgcttcggcttgttgcaacatggtgtgaacttcttgctgaaccgcattgaccagcttgctggaggtatggcggtttaccgcattcagttggcgattgaaactttcaaattcaacctgtgccgccaggttagtgccgttgcgatccatgagcatacgcacgggtgttggtggcaagaaacgggtcagttgcaagtgtttcggtgcttgtgcctcgaccacgtaaactaactcagccagcagggtaccgacgggtaaggctttatttttcaataaagacaccgcgcaactgccggtatcgccagacaggatcaaatccaacccattgcggatgatggggtgttcccaactgacaaactgggcatcttcccgcgagagtgcctgttcacgatcaaaggtgacggtgcagccatctggtggcaaaccggggaaatcgggcaccagcatgtgatcggacggggtcagcacgatcaggttatcgctacgatcttcctggttgatcccgacaatatcgaacaggttgagtgcaaaactgactaaattgatgtcattatcttgttcggcaatgctctgtgccagctcctgcccatgttcgccaccgttagagtgcatctccagtaagcggtcacggccctgttccaactgaagttttaacccttcgtgctgctgacggcaggtgtggataaactcatccaacccttcctgctcacttggcgtggccaaatagctaatcagttcctgatagctgctgtcataaatggtacggcctgttgggcaggtgtgttcgaacgcatccaacccttcgtggtaccaacgaaccagtattgcctgcgcggtgtcttccaaataaggcaccataatctggatttcacggttctggccgatacgatccaaacggccaatacgttgctccaggagatcggggttgaacggcaaatcgaacatgaccagttggcaggcaaattggaagttacgcccctctgaaccaatttcggaacacagtaagacctgagcaccatcttcttctgaggcaaaataggcggcggcacggtcacgttcaatcagcgataaaccttcatggaagacggcggcccgaatagcttcacgctcacgtaacacttgttcaagctgcaaagctgtagcggcttgtgcgcagatcaccaacaccttctcaccccggttggcaaccaaatagttcagtagccattcaacccgtgggtcaaagttccaccaggtggcgttttcgccttcaaactcctgatagatttgctcgggataaagcatatcttttgcacgagcgtcgagggttttcttcgcccccatgatgccagagaccttaattgcagtttggtactgtgttggcaatggcagcttaatttggtgtaagacgcggtgcgggaagccttttaccccattacgggtattacggaacagcacccggctagtaccgtgcctatccatcagcatggtaactaattcttgacgcgccgcttcgctgtcttcactttggctattggccgctttcagtagtggctcaatatcttgttcatcaatcagttcacctaacagattcagcttatcatcggttaaacgctcgccccctaacagcagggtgacggcatcggcgataggccggtatttctgttgttcattgacgaactcttcgtaatcatggaagcgatctggatccagcaaacgcaggcgggcaaagtgactttgttggcccaattgctctggtgttgctgtcaataacaacacgccggggatatgctctgccaactgttcaatcacttgatattcgcggcttggagcctcttcgctccaggccagatggtgcgcttcatccaccaccagcagatcccaggaagcatcggccagttgttctaaccgctgcttattccgacgaacaaaatccagcgaacaaatcaccatctgttcggtatcaaacggattgctactgtccaacaaggcttcggaataacggctgtcatcaaacagtgagaagcgcaggttgaagcggcgtaacatctctactagccactggtgttgcaggctctccggtaccacgatcagcacccgttcagcacggccagccagcagttgctggtggataatcatcccggcttcgatggttttacccaaccccacttcatcggccagtaagacccgtggcgcgtggcgctgacccacttcataagcgatatgtaactggtgtgggatcaggctggcacggataccgcgcaggccgctccacggcaaccggaactgctcgctttggtatttacgggcgcgaaaacgcagggcaaagcgatccatgcgatcgatttgaccggcgaataagcgatcctgtggtttactaaaagtcagtttgctatcgagcaaaacttcacgcatggcgacgccggtttcctcagtatccaaacgggtaccgatataggtaatcagcccattttcttgagtcacttcttccactttcagctgccagccttcgtggtgagtgatggtatcgctcggattgaacatgacccgggtgattggcgagtcatttctggcgtaaaggcggttttcaccggttgcagggaacagtaaggtgatcatgcgcacgtcaatggcaacgacagtacccaatccaagttcgctttctgtgtcgctgatccagcgttgaccaagtgtaaaaggcataaattatcggctcgatttttttgttggacagtgagttagagaattctttgtcgatcaatgttttttcgatcaatatcttgtaaaacaatgttggggtagaacaatctttttttagaacaatctttttgtagaacagtaccttatataacaacgtcttgtagaaacccctgagtaaatgatcgcagagagcggtactaaaatggctggcgatagttttttatctgcgcaacttgcttgttatctatataactcgctttttatccacataactcgctttttatccgcattagtggcacggcctgaatgtctgtctgagaaggtacggttcacaggcagaatccggtggcgcggataacaacgatcagtcggttatgtaaatgtgattgatacaaattttggcaagggcgctatggtaaaggaaggcgagcgcttcgtcacctctaaaacaaccctattatcattaaaaaagtcccatctgaccggtgatcagtgtggtgaaatcatcctgagtgaagggaagtatagcgtctgctacgggttgtagctggcgtgtcagatagtgatcataatcgatgggtgattgccgcgtttctaaaggttcggggcctgcggtggtcatcacatagctgatccacccgccattttgatattgcagtggccggccaagcttacggttaaactcatcggccagacgtgccgctctggcgtgcggggggacgttgcgctgatagtcatccaaccgccgacgcaggcgtttgcggtaaaccagttgctcatccaactcgccattcagggtacgggctacgtaatcccgcacataatcttgataaggttgctgctggaagatacgcagatacaactcgcgttggaattgctgtgccagtggggtccaatcggtacggacggtttccagccctttataaaccatttgatcacccgtcggggtggagatgagtcccgcatagcgttttttactgccttgctccgcgccccgaatagtgggcatcaaaaaacgccggtagtggatttcgaactccagctctaatgcacagggcagattaaagttttgctgtatatggttttgccaccattgattcactaactgcaccagctcgttaccgatgcgtgttgcttgctcatcgctgtgggcgcttttcagccaaacaaaggttgaatcggtgtcaccataaatcacctgataaccctgcgcttcaattaactcacgggtttgtcgcatgatctcatgaccacgcagggtaatggatgatgccagccgaggatcgaaaaaacggcagccgctggaacccagcacgccataaaaggcattcataatgattttcagcgcctgtgacagcggcttattttgctggcgtttcgctgcttcccgcccttgccagatttggttaacaatggcgggcagacaatgtttctcgcgtgagaaccaggccccacgaaaccccggtaccgagtgctgaatatcaggttgctgcatccccgccaccagaccgaccggatcgattaaaaaggtgcggataatcgatgggtacaggcttttatagtcaagtaccagcactgaatcatacaaaccgggctgggaatccattacaaaaccaccggggctgtgctcttccggcaattcacctaaattgggggcaacatagccgatacggtgcatccgtggcagataaaggtgggtaaacgcggccaccgaaccgccactgcgatcggctgccagcccggtcacggttgagcgttcaagtaagaaactcagcaactccgttttggcaaaaatccgcgtgaccaactcacagtctttcaggttataacgggccagtgctggtttatcgtgggcgaagcgctgattaatttcatccatccgctgataggggctatcgctggctttaccctcgccaagtaaagtttgcgagacagattccagactgaaagaagggaagttccacgtggcggatttcagtgcttcaataccatcaataattaaacgcccggcggcggaagcaaagaaatgcccttgcttaaagccgtgttcacgccactcgagcaggttaccgccacggccaaagcgcagcgggatctggtagcgatctgcgtgtttctgtaatacccgtaaatcgaactgcaccagattccagccaataatggcatcaggatcatgcactgccagccattggttgagtttttctaatagtaatgggcggctggcaacgtattccaaattgaaatcgagcggggtgcccgtggtctccccattgggtggccctaacatatagacttgccgttgcccacagccttccagcccaatacagtacagctcgccgtgttcactggtttcgatatccagagaaaccagtttgagggttgggcgatagtcatcagccggttttagttgtgtattgaggagtgggccatggtcattttcctgcccactaaaccatacgggggcagtaataaaccgctccatcagaaagcgttctggcgggcgaatatcaccttcgtaaacattcacgccactttcgcgcagtcgtttttccaggcggatcaactggcggtgctgagtgcaatacaggccaagaaccgggcgttggtgaaaatcagtcagcgcgagagggcgcagttgccaatggcgttctgcgcgtagtacggtttctgcccgttgctgttgttcggcagggataaaggcgaccgatggctggggcggcagcctgacatgctgtggcccttcatccgttgccaaccagaattcgacttcggtgcctgctggtgtatcccgccagtggcgggtcagcaggaagccctgacgggtttgccccacgctgctaccttaaattaagatgtgaatgaataacatttgaagatttatactgtattagtatgggtttttatacagttattgtctatttcaatagcaaattgaaatctatttacgccaatcgctgattgactcattttacgttgcgctggacaatcctcgcgcctcagttctgagtgctaactaacggacaactttatggaagcctatttattacatttattgacgcaatccctggctttcacgctatttatcgtcatgttagtcacttttctcgaatctttagcgctggtgggcatgttattaccgggaacggtgatgatgaccagcgtgggcgcgctgattggcagtggcgaagtggatttttatttcgcctgggttgccgcgaccctcggttgcctgttaggggattggatatcgtatttcattggccgccgtttcaaagcgccgctacacaattggtctttcctacaaaaacataaatcgttgctgaataaaactgagcatgcattgcataaccacagcatggcaacggtactcttggggcgttttattggcccgacacggcccatcgtacccatggtggctgggatgctgaacttgccaacggcaaagtttgccttacccagtgtgattggtggcctgacatggccgccgatttatctcttccccggtatattggcaggggttgccatcgatatcccgccgagcagtaatagctttatgtttaagtgcctactgtttgtggtggtggtactgatttggctgtcgttgtggttatcatggcgctggtggcgttttggtaagcgcagcccagatcgcctgagtgtgtggctccccttggcccgcttgcgttgggtgactctgttaactattgcggccgctatcgccagttttatctggctacatatgcaaccactgatgccaatctatcgccatctgttgtggaaagtcttggctgggtaaacccggacacggtggctgacagccctattttatcgtatatcagccgccggggttaccgccgcgagggatcaagatataacggcacttttgatacccagtacgctggcttttgccgcactgccgtccaccaaggcctgtgtggggccatcgtagtcaatacggccctcaacaatcaacaacgtgcgctgggcaatacgtgcggcatcatctaaattgtgcgacaccatcagcaacgtcagttggcggtttatgcacacctgatcaactaattgcagcatttcattacgcagcgccggatccagcgctgaaaacggttcatccagtaacaaaataggttggctacgcaccaggcagcgggccaatgccgcccgttggcgttgcccccccgagagttgtgcgggcagccggtcgaggcagctttccaatccaacttgctgggcgatgtgttgtaacagtaagcgctgttcaccactgagcttcaaccccggatgtaaacctagcccgatgttctgttcgacggtgagatgtgcaaacaggttattctcctgaaacagcatcgataccggcctttgggcgggggggctggccgtatgatcttgattattcaacagcatgtgaccactggtcggggcgagaaaaccggcaatcaagctcagcagggtacttttacctgcgccgcttgggccaaggatcgccacccgctcaccaggttgaatgtgcagatcaaaacacatgggtaagtggtcatacaaataggtgattttctcaagctttagcatggcggctcggcagtcgttcaataagggtaaacagcaggaagcagagcaacaagagcaacagggcagtcactgcgccatcattgctgcggtaggaacctatctgttgataaagataaaatggcagggtgcggaagtgttcattaccaaataacgcgactacgccaaaatcgccgatagataacacactggcaaaggccagcgcctgagccagtgggcgtttcagggcgcgtagctcgatataacgtaaacggtgccagccacggatatccagtgataaacataacggtgtgtagcgctcagccagatcacgcatcgggttatccagcacttttaatgcgtagggcacggccatcagggcattggtgaggatcaccaacccataaggagattgcggcaatcccagcgtatcattcagcaacaagaagaaaccggttgccaacacaatgccgggcatcgccagaataaccatgccgctgacctccaatgcctgaccgtaagccgcgcgttggcgtaatttcagttcgcggctactccagagcaacatcatggttaaggtgacacacaatagcccggcaccaatagcgatggtcactgaggtaaagaacgcttgccagagtgcgggctgttgtaacacggtcagtattgttttattactgccatcaatcacaactgctagcaatggcggtaccatcaagagtaatgcgctacaaatcagcagggtatcgccaaggcgcgcccagccgctgtcttgcggattacgccatatttgcccatgcgtattgcccaccgtcaacacgctgttcagccgctgactgagtaccactaaacccaggcagcagcccagttgtatcagcgccaataatgcggcacggcctaaatcatagtcgtagctcaatgcctgatagatggccagttcaatggttgttgcctgtggcccgccacccagcgacagcacggtggcaaagctggcaaagcacaacataaaaatcagggcggcagtgggcaggatttgacgacgcagataaggccactctacccagcgaaaatgctgccagccgttcatgcccagttgtgcggccagttggcgttgttccacggcgatgccttctagcgactgtaacaacaagcgggttgccagtggtaggttaaagaagatatgcgctaacaaaataccttgcaagccatagggggagaagcggtaatccacacccagccagtcaaacaggtgagccagccacccctgacggccatagaccgtcagaatgccgaatagcgcgactaacaccggcagaaccagcgtcatggcacataaacgcagcatgaactggcggccggggaagttgcggcggtacagcgcccgcgccagaaagatagcaggtatcaccgacagcagggcggataaaaatgcctgccagaacgtaaagcggatcacatgccacagataacggtcatgccagacactttgccaatctgctgtgggcgcatggtgccaaatagcggcgaacgccaataaggcgaccgcgacaatcagcccagcggccagcaaccccggccatagccagggcgcgattaacggctgacggcggattgccatgcctgaatccatttactgcggttatccgccacgtctttagcatcaaattgcaacgctgtttgtggcacggccagtgtctcgaacccggcgggtagatccattttgatcactggatacatccagttgccggttggaatgtggttttggaacgcaggggtcacgataaattgcataaagcgctgcgccagttcaggttgtttgctggcggccagttggccggcgacttctacttgtaaatagtggccttcactgaaatcggcggctgcatagttgttattcttttctgcaattaaatgataagccggagaggtggtgtagctcagcactaaatccgcttcccccttgaggaacaagccatacgcctcgctccagcctttggtgactgtgaccgttttctgcgccagttgttgccatgcttgcggggcttgatcgccataaactttttgcatccacagcatcagacccagacctggagtgctggtacgtgggtcttgataaatcactttccacggttctttactgctgattaattcgtgcaggctttttggcgggtttttcagtttttctttgttatacacaaaagcaaaatagccataatcgtaagggacaaatgtcttattctgccacggctctggtagggtcaggttacgggtatcaacctggcttggggtaaacaagccggtttgttctgccgcctgtaccagattgttatccaaccctaaaatcacatcggcctggctgtttttaccttccatccgcaggcggttcagcagtgaaacgccatcttccagtgccacaaattttagctggcaatcgcattcagcttcaaaggcctgcttaatcgccgggcctgggccccagtcagcagcaaaggagtcgtaggtatagaccgtcagcgtaggtttttctgcggcaagcgcggaggtggctgatatcagtaataagcaggaaataatgtgtttaaacactttgcactccttgaacataaaggtggcaaaggtatctgaggcggtagttaacattggtatccgtgatgatacagtcgttatcattctcaaatccctccgccggggttaaccggatcaggttcgacgggtttactctcagcgaaaaaaattgcggcggttaggtggttccagtgttgagcagtctgggtgatccgcgcatcgccatgattgataaagtcatggtgtatgtaccggtcactccgcgctgttcgccactgtcataaccccgctcgttgtgttttgacacctgcgagaccgagttaaaccaagctggcaatattttgcaccccgttgagacgacgccattgtagagtttaatctaagccggtgaaagggcgatgtttgtggggaggggggagggggatttccctcattcgaaaatgtctcatcataattccccgatctctttggtctacttttgcacaatatttaacactttattactggcactatcgatcaatgatgataaaaagtattttaggcgttttacctcgcattgcttaatgccttggtggatttcaatgctggcgaggagctgtcgcattgtgtgaataacataaaatttgtattaatgtaagaatgtgttaaacaaaagtgagttaaattatgaagacattttatcaatttcgtgatgaacaaaagaaaaagcttgaagaacatgttttttatgatctgattagcacagataaaatcgaattcaataataaacttatgtttatgcctgctatggttcattttatcatgaattttagagatatgaacaaatgggttattagatttgagactcctgatactcgtttcaaatcggtaatcaacggtggcaccattgaagatgaaacacactccagattatttcttgaggactggaggaagctacatattgatgataagttaaaatggaattccagtgatattatttactggttatttatcagctcggagatggagtgtttcagaaaatatggaattgatttcatgaggctctgtatagatgatgaaagtgatcctattttacgttatgctcattctgaatcaggagaaacatgcggtaacgtgtttttttcgagaataagtcctattgccgatagaatagctgagaatttaaatatatcacttcgttactttggaacatttcacctcaatcttgagaatggacatgtctgggaatcggaaggtgtgttcgagaatatagtattggagcaagatgccaatgaaaaagtcaggagcctctcacagcgcatgtttgatatttttcatgggattcacaatgcattttacaattatacgtctaattatattctgacacagtcctacccaaaattcccagaaatgttaactataggtaacaatgagtacccacagtatcctgaccttttccttatcaccgggaataaccatagtaacgatataatccaacatataaataattatcttgaacagatatccaagcatccattttatgaatggctaaaatctacttctattaatccgctaataaagttaaaaagttttatccctctgtggatcgtggacattatggggtacagagatattaacaggtacgtctttccttatgagcggatagaatctgagagtgaaagactcataactgaatatgcattacttctttcagagcatagttatttattttataatgattggaaatcactgcagcttgatgaaatgttacgttggacagcaagtgacacacttgatttcatatttcttaatgcagatatggatacccatcgagaaaacttggttaagttttcattgtgtgggttaaaaaattcagaaccgttaaccagattctggtttatgatgatccttgagttaagtggtaaatcattcttttcgtatgttggtaatgtggctaaattggcagagaaggaatataacatcagtctcccatatttaagtggaaaacactcatcagtaaaagaacttaatgtttttaacgagctctatactcattttatctcacaggaactaaaccaggaacaaaaaataaaaatcaaggaaatagctgatatggtgctgacagctttgttaaagaatctcgatatatcgtacaaatatgcagtaaataatctatttgctgctcgttgattgctcccgctgtctgtaattccaatatgcacttgcgctggatgttgagtgtcgcgttaatatcgcggtcacgttcagtgttacggtaagggcattgccagatacgtgtataaagagaacagctagcgagcgctagctgttaaaatacttaatggtggatttgcgccaaatcgtcttcggaaaggccagtcgcttcttgtgccgattcgcgcaacattcccatttttagcaaactgcgcgctacttagagtttaccttcctgtcgaccaagctgaatgcccttctcgatacctttctgttcgagctgttgtgcgatggtcataagtgcgtctccgtgttgcagcacacgctgtgccagttcgcgtaccaggaccattattcatccgcattttcagcgaatacctacgatttgccacgttcctgtccagcacacacaacccgttgtgccggaatattcaggtcaatttcaatagccagagcttcgcggttaaagtcatccacgacattgaacgtcctgaatcgtctgccacagaccagtgcatcatgcataaaatcaatcgaccagctttgattcagctgctccggcgttgccagtgatgccggattacgcaccggcaggcgttgttctcccttacgacgaaaatttaatttcagcagacaataaattcggtgaacttgtttatggctccagcgttggctctgcctgcgcagtatctgaaacagcttcttaaagccgtatcgcggatagcgttctgctgcctctgttaacccctgaatcaccggtttatcatcgcatataaaaaattttacaataaaaaatgagagtatttaactcgttctcataaatggaattattgaaaggggtagtgcagcccgtttgtataataaattcagggggagcgccgtgtgagtcaacgccgccctaggcctctggtggggtaaaccatgcggatttaaaatcaaaccagccgagtgtattcatacgcactccccgcatactgtgttgaccgtataattctaaccaatgatgaaatagcggatggaattgatgctggcttaccagtcgttggctccaatcggccatgagtaaggtattattgcgccaggattcaatatcttgatgcagttcttcgctcagacaatgttgtagtagcggcatttcatagagggtggcaaatagcgagaattcgagtggcaagtaaaagttagcgctgccgagccagatatcgctttgtgcatccccctgataccagcgggtgtagtccaagacttgtatctttaacgtcacgccctgagcagccaataactgggtcagtgtctggctgatggcatcaaactctgaatgttcgctgtaaaacgtcagtgtcagctcgttcagcccttcgggttttggctcttgagtggtgagtcggttatggtgccagcgtggcaacatgccataggccggtgaccagtaacgttgatagaagggatcggcgtggctgagtaacgctatcggtgtgatcaattcacataaccaacggcggatctccggggtgcaggcctgaggggatcgttggtcgaacagtaagaagtagcaaccttcctctaaacggctctccagctcatttttacccgtatcgtcggcttgcaattgcaccccggaatacaccaattcttcggagagttctgggagtacccagatattgacctcatcaatcagtgcccggaaaccaaaatagttatcgaatgcctgaattttcagctggctgtgatgattgcggatcacggaataagggccggtaccaataggctgtcggtgaaaatcgggctgagtttcccactcttgcggcaaaatcatggcgtgaacgctgcccagtagccatggcaaccagtgatctggcgaatggagataaacatcaatcacataaggtgtcggtgaacgcacctccgcaatatgagaaaacaggggttgggggatcaggcgggtcaggctgctaatcacatcactcatttccagttcccggccatggtggaaatgaatggctggtcgcaaataaaagcgccaatgcaagggggtgatcgcttgccagtgatgagataagtccggttcgagttccccattttcctcatttatccgtgtcagcccgttaaaaatttgccgcaccatatgggtttcagagcggcgtagggcggtgccgggtaataagttctccaatgggcggtaatagagcacccgcagaatatgttttccttgccggaagctacgtcccaactgggacagcaacatttggcgtaccgcttttttatcaccgaccagttggactaactgatcaatatgatcctgctccagcaactcttcagcccgttgttgttgcagcgccagcccggaacgcaagaagatcaattgtgagcgttttcctcggccagcttcagcctgccaatcgagccagcccgcgtgctgcatcttgcccagcagagaacgtacatggcggcgtgaacaattcagcacttcagccagcgcctgcaatgtggtttccgttgactgtccgttatagcgttgccagagacgaataaattgttgttgcaggcgcgaggtagacataaaagaggaactccttgggaaatctcatcaatttttctttccctatattacgcagatactaacccccaagaaaagcgggttatcgtgacaacgtctatgcagtcacagccgaaagtaatgagttgagccttgtcctaccaagtaccaaaaaaattctgagtaatggtgtttttcaccagccagtaggtttttctgctggcttttttctttttccccttcggccttgacgctgcagggttgttagctgcgcgcactcacccgaatcacttacttgagtaagctcatcgggattcgtttgctggctgcctacctgcaacgccaatgactttggggaaatcccttcggccttgacgctgcagggttgttagctgtgcgcactcacccgaatcacttactggtcgttgaccttaagataattagcctcatcgggattatgagcctcatcagagtctcaccctgcgggccagcgcaagcgctgttcaaaatagttgaaccaatttgtcgtttgctggctgcctacctgcaacgccaatgactttgaatagataaaagcctatatcacttctttatgtataagagcttctgtagcatagggcaccattatgattatgctaataatagctttttctggcgctggagcctggaatgagatctgcacgagccttttcccgtcgtatcaacccggttttcctcgctttctttgtggtggcttttctttccggcatcgcgggtgcgttgcaagccccgacattaagcctgtttttaagcacagagttaaaagtgcgtccgctgtgggtcggattgttttataccgtgaatgccattgccggtatcaccgttagcttcctactggccaaacgctcagatctgggtggggatcggcgtaaattaattctgatctgctatctgatggcggtcggaaattgcctgctattcgcctttaatcgtgattatctgacgttgatcactttaggtgttttgatggcctcggtggcgaataccgcgatgccgcaaattttcgccttggcacgggaatatgcggataactctgcgcgtgaagtggtgatgttcagttcgattatgcgtgcgcaattatcattggcttgggttatcgggccaccgctgtcatttatgttagcgctgaattatggctttacgctgatgtttagcattgccgccggtatttttgttattagtgcgctggtggtctggtttatcctgccgtcggttaaacagcctgagcccgtagccgatgccccagtggtggcacaaggcagtttgtttgccgataaaaatgtcttactgctgttcattgcctcaatgctgatgtggacgtgtaataccatgtacatcattgatatgccgctctatatcaccgctaatttagggttgcctgagcggttggcgggtttgctgatggggaccgccgccgggctggaaattcctatcatgttgttggcaggttattcggttaggcgctttggtaaacgtaaaatcatgctgtttgcggtgatggcgggggtgctgttttataccgggctggtgctgtttaaattcaaaaccgcactgatgatattgcagatttttaatgccatctttatcggcatcgtcgccggtattggtatgctctattttcaggatctcatgccggggcgggcaggtgccgcaaccacgttatttaccaacagtatttctagtggggtgattttggccggtgtgctgcaaggtgtattgactgaaacctgggggcataatgcagtttatgtcgctgcgatggtgttggttattctggcgttgatcatctgcgccaaagtgagagaggcttaggtgagagcggtttaggtcagcgcagcttagcggtttgcccctgctttgtgccagaagcggcgggggtcagctggcggtaggatgagttaaacgtgttacttgttgggccggtacgacccggcaccaacaatctattagttacttacgatctattagttacttacgatctattagttacttacaatctattaatgactcacaatctattcactactaaaaataacgatatatttactaaacaggctggcatgttagttctgctggccttaacggttatttaacgtagaaattcaggctgttgtttttcgtatgctgagatattgtgttcatgctgcaacgtcaagccaatgctatccaacccattaatcatacagtggcggcggaaaggatcgatttcgaaagcatagcttttgccaccggcattaaccgtttgctgctcgagatcaaccacaaactcaataccttcattctctttaaccaattggaataaggtatcaatatccgcttcgcttaatgtcaccggtaataattggttattaaacgcgttaccataaaaaatatcagcaaaactcggggcgataaccactttaaaaccaaaatccgtcagcgcccatggtgcgtgttcacgtgaggagccacagccaaaattctcacgggctaacaaaatagtggcaccctgatagcgaggcaggttcaggacaaaatcaggattcggtaccttgccggcatcatccaaaaaacgccaatcgttaaacaggtgttgaccaaagcccgtgcgagtcactttttgcaaaaactgcttggggataatcgcgtcggtatcgacgtttgctgcatctaacggcgcaaccaaaccaatgtgttgaataaattttgccatggtggtgtctccggttagtgggtggcggcggataattcgcgaacatcagcaaaatgaccactgacggcggcagcggcggccatggccgggctgaccaaatgtgtgcgccccccacggccttggcggccttcaaaattacggttgctggtggaggcacaacgttcgccgggctccaggcggtcattattcatggccaaacacatcgagcaaccgggcagacgccactcaaaacctgcggcgataaagatcttatccaaaccttccgcttctgcctgcgctttcaccgggccggagcctggcaccacgatagcttgcacacccttggcgactttacgcccttgggcaatagccgctgccgcacgtaaatcttcaatacgtgagttagtgcaagagccgataaagactttatcaatcgccacttcagtcaatttaatgccggggcgcaagtccatataagctaaggctttctctgctgatgcacgttcgaccggatcgctgaaagactcaggggcaggaatgatttgattaaccgcaatgacctgacccggattggttccccacgtcacctgtggcgcgatatcagcggcatccagtgtcacgatggtatcgaattgggcatcagcatcagatttcagggtacgccagtaggcaacaccttgttcccattgctcgccagttggggcgaactgacggcctttcagataggcaaaggtggtgtcatcaggggcaaccaaaccggctttggcccccatttcgatcgccatgttgcataatgtcatccggccttccatgctcaatgcttcaatcgcgctgccacagaactccaccacatgaccagtaccgcctgcgctaccggttttaccgataatcgccagcacgatgtctttagccgtgatacccgcgccgacagtgccattcacttcgattctcatggttttggctcgtccctgcttcagggtttgggtcgccaacacatgctcaacttctgaggtgccgataccaaaggccaaggagccgaatgcgccgtgagtggcggtatgtgagtcaccacaaacgatggtcatgcccggtaacgtcatgccttgctcagggccaatgacatgcacgatcccttggaaagggtggttcaggtcatacaatgagacaccgaattcagcgcagtttttaattaactcttgcatctgaatacgggccatctcaccactggcgttaatgtcttttgtttgggtagaaacgttgtgatccatggtagcgaaagtcttacccggttgacgcaccgggcggcccatggcacgcaaaccatcaaaggcttgcggtgaggtgacctcatgcactaaatggcggtcgatatacagcaatggggtctcattgggggcttcatgcacaatgtgcgcatcgtacaatttttggtataacgttttgctctgagatgatgttgtgcccattttataccccctcaaccacgaatttagcgatgatatcgcccatttcgtgagtgccgattgcgtgaccatccccggctaaatccgcagtgcgataaccttgctccaatgcctggttgatcgcgcgctcaatggcgtcagcggcatcatctttacctaagctaaaacgcagcaacaggattaatgacaggatctgagcgatagggttggcaatgttcttacccgcgatatccggtgcggaaccgcctgcgggttcatatagaccaaaaccttgttcattcaaactggctgatggcaacatgcccatggagccggtgatcatggcgcattcatcggacaagatatcgccaaacaagttagagcacagcaacacgtcaaattgggaagggtctttgattaactgcatggtggcgttatcaatgtacatatgggacaacgcaacatctgggtaatccgccgcgatcccgttgaccacttcacgccacaagattgaactttgcaacacgttggctttatcaatggacgttactttactacggcgtttgcgggctgattcgaaagcaatacgggcgatacgttcaatttcaaagcgatgataaacttcggtgtcaaaggcccgctcgtgcatgccttggccttcacggcctttcggctggccgaaatagataccgccggttaattcacggacacacaggatatcaaaacctctggccgcgatatcactgcgcaatggacagaaatcctccaatccttgatacaaacgggcagggcgcaaattgctgaataatttgaaatgtttacgcaaaggcaataaggcaccacgctcaggttgttctgccggtggcaggtgttcccattttgggccgcctacggagccaaataaaatggcatctgcctgttcacatcccgcgaccgttgctgccggtaatgggctaccatggcggtcaatggcagcgccaccaacatcgtaaacactggttgaaatcttgagaccgaagcgctgacgcaccgcatccaatactttacttgcctgagccattacttcagggccgataccgtcgccgggcaacactgcaatatgataagtcttcgtcatgttcacaccatttcctgattattttgttgcagacgctgcttctctttttcgacctgatgggcgcgccagatgttatttaatacgtgaaccaacgccttagcggatgactcaacaatgtcagttgccaaacctacgccatggaagcgacggcctttgtggtcaaccacgatatcaacctgacccaatgcatctttaccctgacctttggccgacagttgatacttcaccagttcaattgggtagtcggtaatgcgattgatggcctgatacaccgcatcaaccgggccgttaccggtggccgcttctgattttatttcttcaccacagaccaattttactgaggcagttgccatgacactggaacccgactggacgctgaaatagtccaaacgataatattcaggctcttcctgctgcttattaataaaggccaatgcttccaaatcgtagtcaaagacctggccttttttatcggctaatttcaagaaggcatcgtacaaagaatctaaattgtaatctttatcctgataacccatctcttccatccggtgcttcactgccgcacgacctgaacgggatgtcaggttcaattggacttctttcagaccgatggattccggggtcatgatttcgtagttttcgcgatttttcaggacaccatcctgatgaataccggaggagtgagcgaaggcattactgccgacaatggctttattgccgggaataggcatattgcaaattttactgaccaactggctggtacggtaaatttcctgatgattgatattggtgtgcacgcccaacatttcatggcgcactttaatggccatgatcacctcttccaatgaacagttacctgcacgctcacctaagccgttgatggtcccttcgacctgacgcgccccggcttgtactgcggtaatggagttggcaacggacatgcccaagtcatcatggcaatgaacagagataatggctttatcaatattgggaacacgttcatacaagtcagtgatgatgccaccaaattgataaggggtggtgtaaccgacggtatccgggatattgattgtggtggcaccggcggtaatcgcggcctcgacgacacggcataagttatcaattggagtacggccagcatcttcacaagaaaactcgacgtcatcggtatagttacgagcacgtttcacggagtggaccgccatcgccagcacatcgtcaaacgaacgctttaacttggattcgatatgcaaggttgaggtggccaaaaacacatgaatacggaaagcttctgcaattcgcaatgcctctgccgcaacatcaatatctttatccacacaacgtgccaaggcgcaaacccggctatttttcacttgctgagcgatagtacgaaccgattcaaaatcaccaggggaggagacagggaaacccacctccatgatatcgacccccattctttccaatgccagcgcgatttgcagcttctctttcacactcagactggcttgcaatgcttgttcaccgtcgcgcaatgttgtatcaaaaataatgacttgttggctcatgggttgttcctttttttacatttgcgctcagcggataaaaaaaaacccgcgcatttgcgcgggcttgttaatcttgatggctgaatcagttctgatttccgtccaccaacataccgcgcaagagagatgcgttaagtagtaggcttagtagacgggttgagtagaacataaatttcagcttctcatcagtgaaaatattgcgttgcctaaattgatacgtgaattctatgtttgtgtcaacaattgtttaaaatggcgacttcaactggttgagcgaattccgacttcttttaattggagctaaaatccaaaataatcatttttacagagtattatcctgagtaagtcactcatgattttttaattgtttggcataattaccattatctgggttattgtgctttccgtgtttctccgcggcggcttgtcgcccaacccaacatgaatgctgattgttttgcctatttgattcgatttttttatgagttaatgagagtgataggggcagtgttgagatgtataagataaattgatccatgtaagatatcgccctttatccatttttttttatgatgcttattaaagattagtaactatttttatatgagttgtatatttatagtcttgatattttgtgactaaatcaattaattataattaaataaaatgaagtgctttaaattattcaatgagtttctgcgtaaaattaagaaatgataagttttaattgatgaatttattatttattaatggcatagttgtcaatcatctcattttgtgatgtgatcatctcgttaattttattattggtgattataattaaaatttttatattactaatataaatttgttgtggtggctatataaatgactttgtataggttttttgtttatgtgttttttatggagaattactgacaacagaatgcattaggtgtgaaccgtatctcacatttatacaaggatgaaactcaaatttaccctacaaaggtaatacaagagaacattggcgttattaatagtaagagattaaggatattgcaacagcgtctacccatagccattggtgttacagcaagaaataatgagcgaattttgatgcgctagctcacgtcagtgagcggcacgagcaacgttgaagaataagggtatatcaatatcagagaagtccttttattaatcgcgccatctgcataaagcttagtggagttaagcatgtctgaatacaacttagtaactgacagtcaagcaactaaaaaagaatctatcgatgtccatttaagaagtgtcgacctaaatttgttaactgttttcgatgctgtgatgcaaatgcaaaatgtgacacgtgcggcacagtctcttggtatgtcccagcctgctgtaagtaatgctgttgcccgtttgaaagtcatgttcaatgatgagctctttgtccgttatggtcgtggcatacagcctacagccagagcccgtcagctcttcgggccggtacgccaggcattgcagttagtacaaaatgagttacccggtgcagggtttgaagcgaaaaacagtgaacggctgtttaatctatcgatttgtagcccgttagatgttcgactggcggctcagattgtacagcgggtaaaacaatcagcgcctaatgttcaactggtcatcaaatcttatcttaatgacaacattgagcatcaactacgttatcaggagaccgagtttgtcatcggctacaccgagttcgaccgcccggattttcaccgcatccctttatttaaagatgaattagtgctggccgtttctaaagatcacccacgtattaatgattcaattactgaaaatcagctcctttccgaatctcacgcggttgtatcattagataaaaaagggtcattcagtgagccttattacgactcaacaaccagtactcaatctattgcttatgaaagtactgatatgaacagtgtgctaaatattgtttctcagacttattttgtggcaattgctccccgctggttggtaaaaacatacagtgaggcgttgaatctaaagttaatttcattaccttgggaaaatacttcgcgcgcctgttaccttacatggcatgaatctacggatagagataaaggccatcaatggatgaaagcgttactcgggcaatttagttctcccgtttaatgatttatcattaagttatgatcattaagtcctgctgctgagttcatcttgttattggtagcaggcaatcattccctaaccatatctcatattttcatctcaaaaaatcgcatcgctcacggcaatgtatgctgtttatcgaaactgattatttttcggaactgattatttttcggaactaattgtttttcgaaatagattgtttatcgaaatagattgtttttcaaaatagagtgtttgtcacaaatgattacccatcgaaactgatagcgtacacagcaacgcctattgcacatgatcgctcgttcagttcagttcaattcaattcaattcaatgaaatgccatgggatgacggagactcccgctaatttatcgtccagcccgttgtgtttttcatcaaaaccttacctcttatatggaatattatttgccatagcgcacagagtgagtagactgcgcgaaaaaaaagtgaacacctgtacgctgaatgttgtcgtacaaatcttgcaacacactttaatggatatttcaccagcgagcggtaattctttatgattcataaattacatcaatatcacctggtacgtaggttgcgtcagcaagtcagtgaccgttcagagctggtagcctttcgtgaatggtcaccagagggtgaaaagcagctcaactggcagcaaattgacgagcatgtcactcggatttctactgcattgctctctttgggggctgcaatacaagagcgcattggcatctttgctaataacagtatggcgtggtcacttgtcgatctggctattttacagttacgtggcgttagtgtccccttgtatgccaccaataccgccgctcaggcagcctatatcgtcaatgatgctgatgtgcggattttgtttgtcggtgagcaatcccaatttgatattgccatcacgctgcaacctctctgcccgcaactggctcatatcatcgtcttggatcctgcggtggacttacgtggctgtgagtacgcccagcatttggctgactttgagcagcaacagcaacccgataccgtacaacagcacctgttaactacgcgcattgaaggctgtgatttagacgatctgtttacgctaatttatacgtcgggtaccacgggggagccaaaaggcgtgatgttggattaccgtaatatggcagctcaactctatttgcatgaccagcggttaaccctcacaccacaagatgtgtccctcagttttttgccgttatctcatgtttttgaaagagcctggagtttctatgtgatgcataccggtgctcagaacgtctatatccgtaatacggattgggtgcgctctgctatgcaggcagtaaaaccaacggtgatgtgcgcggtgcctcgcttctacgagaaagtattcagcgcgattaatgacaaagtcgccttggcaaagtggcatcaacgcgtgctattccactgggcagtggggtgtggtgaacgtaaattcaaacggttgcagcaggggcggccattaccttggctctcagagcagatgtacacactggcagaccgtttggtattgcgcaaattacgcggtgtgttaggggggcgggtacgttttctgcccgcggctggcgcacggttagatgataatatcattctgtttttccaggcgattggggtcaatattaaatacggctatggcatgactgaaacctgtgccacggtttcttgttgggaagagcaaaacttccgctttggttctatcggcaagcccttaccgggtattgatgtccgcttaggggcagagaatgaaattcaggtgcgtgggcctatcgtgatgcgtggctatttcaaaaagccacaagagacgctagaagcctttaccgaagacggatggcttaagacgggggatgcgggtgctctggatgctcagggtcatctgtttattaccgaacgtctgaaagacctgatgaaaacgtcgggggggaaatatattgccccacaaatgatcgaaggcacactcggacaggatcgttttattgagcaggtagcgattattgcggatacccgcaaatttgtatcagcgttgattgtcccgagttttgaatcgctggaagagtatgcccgatccatcaacttgaaatatcacgatcggttggagctattgcgccatagccacattgttaacatgtttgagcaacggctgaaagagatacaaaaagagctggctctgtttgagcaagtaaaaaagtttacgctgttgcctcaggcgttcactatggaaaccggtgagttaacgcctacgatgaagttgcggcggaaaatcattcttcaacgctatcagaatgaaattgacttgatgtatagcgattaatttgttcaccattcctccccgcagtgaccggtgttaagtctcacactggtcgctgctgtctttctgaccgttctgctgtgtttggccctgacctacctatttatgggtaattcccatcattctactgaatccaacgagtgaaaattatcagcctgatttagttccataaccattcactacctcgatgttataaaccagttttaacttgttttctgggggattattcctttaattgacgtaatttcagcgcgtgaccaatataattatctttagtgcggagaattgctgtttgcctgccagaaattctgacgttatgttaataaattcgttacgttaaaaacgctcaaataagtaagaagccacaaataagaataaagaggcgttgcgcctttcctacagaatatcgtggaaatgaattcccgttatccaatgagcaaactaagcccggaggcaaaacccatggagatgttgtcaggagccgagatggtggtccgatcgttaattgatcagggcgttaagcatgtattcggttatcccggcggggccgtacttgatatttacgatgccctgcacacggtcggaggcatcgatcacgtgctggtgcgccatgaacaaggtgcggttcacatggccgatggttatgcgcgggcaacgggcgaggtcggtgttgtactggtcacgtctggtcctggtgcaaccaatgcgattaccggtattgcgaccgcctatatggattcagtgccaatggtggtgctttcaggccaagtgccaagctcattgattggttttgatgccttccaagaatgtgacatggtggggatctcccgcccagtggtcaaacatagcttcttggttaagcgcacagaagacatcccgatggtgttgaaaaaagccttttatctggcatccactggccgtcccggtccggtggttatcgacttgccaaaagacattgtcggcccagcagtaaaaatgccttacgcctatccagagcaagtcagtttgcgctcctataatcctacggtgcaaggccaccgtgggcagattaagcgtgcactgcaaacgattatggcggctaaacggcccattatgtatgtcggtggtggtgcgattaacgccgcttgccatgaagaattactgatattggcagagaagctgaacttaccggtaaccagctctctgatggggctaggcagtttccctggtacgcatcgccaaagtgtcggcatgttggggatgcatggtacctttgaagccaatatggccatgcacaatactgatctgatttttgccgtcggtgtccgttttgacgatcgtaccaccaataatttagcaaaatattgccctgatgccacagtgctacacattgatatcgatccgacatcgatctcgaaaacggtcaccgccgatatcccgattgtgggtgatgccaaacaagtactgacacaaatgttagatttgttgtcgcaggtcggctgtacacaagattttgatagcttgcgcgattggtggcaatccattgaacaatggcgcacccgtaattgcttgggctacaacaaagacagtgggaaaatcaagccacaagcggtgattgaagccttacatcgtctgactaaaggcgatgcgtacgttacctctgatgtgggccaacatcagatgtttgcggctctttactatccctttgataagccacgtcgttggattaactccggtggcttgggcacgatgggctttggcttgccagcggcgcttggggttaaattggctttgcctaatgaaaccgtcgtttgtgtgaccggtgatggcagtatccagatgaatattcaggagttatcaaccgcactgcaatataacttgccagtgttggtattaaacctgaataaccgctatctggggatggtgaaacaatggcaggacatgatttattcaggccgccattctcagtcgtatatggattcgctgcctgattttgtcaagttggctgaagcctatggtcatatcggtgtggctattaatacgccggatgagctggaaagtaagctggcagacgcactgacacaattatccgaaaccaatcgtttggtctttgtggatgtgactgtcgatgaaacagaacatgtttacccgatgcagattcgtggtggtggcatggacgaaatgtggctaagcaaaacggagaggacttaattatgcgccgccggattttatcagtactgctggaaaatgagtcaggtgcactctcacgggtggtggggctgttttctcagcgtggctataatatcgaaagcctgacggtcgcgccaaccgatgacccaacgctttcccgcatgaccatccagaccgtgggtgatgccaaggttctggagcagattgaaaagcagctgcacaagttggtggacgtcttacgtgtcagtgagttggtttctggctcacatgttgagcgcgaaatcatgttggtgaagttgcaagccagtggttatggccgtgaagaggtgaagcgttgtgcagaaatcttccgtgggcaaattgtggatgtgaccgcaacgctctataccgttcagctagcgggtactagcgagaagctggatgcgtttttgaatgcggtgcgtgaagtcgctgaaatagtggaagttgctcgctctgggattgtcggcgtatcgcgtggtgacaaaatcatgcgttaattaatgctgatttcgctctaatgatcgggctcagcgcatagcgttgagcttttttttcttattttttaacctaagtagcgttatataaccgttaaagcggttgctcaatagtgagttctgcggttagatctataacggattatatccatagttaaactatgtctatagcctgtttatccggagatcaccttattttggaggttagatcgctttggaggttagatcgctctggaggccaaattgttggctagcggctcttgctcactcaaatcatttgatctaaatcagttcatcaggatcgttcgcttgccgtctggctgcaacgctgataactctgggtaggcaaattttttgggttcacttatcatcctctgggtcgataagttcggctgaaaagacacagggatgctggctctcggcagagcgctctgcttttcatcactttactgggtttataaggggttaacgtgaaactggatgagatcgcgcgccttgcgggcgtttcgcgcacaacggccagttatgtcattaatggcaaagcgaaacagtaccgggtcagcgataaaacagtagataaagttatggcggttgtcagggaacataactatcacccgaatgcagtcgcggcaggtttgcgcgcgggcagaacccgctcgatcggtttggtgatcccagatctggaaaataccagctacacccgtattgccaattatctggagcgtcaggctcgtcagcgtggttaccagttgctgatagcctgttcagaagaccagccggataatgaaatgcgctgcgttgagcacctgttacaacgccaggttgatgcgatcattgtgtcgacggcattgccgccagaacaccctttctatcagcgctgggccaaagacccattcccgatcattgccttagatcgggcgcttgatcgtgagcattttatcagtgtggtcggggcggatcaggaagatgcgcagatgttagcgcaagaactgcgctccttcccggctgaatcggtgctttatctgggggcgctaccggagctgtcggtcagttttctgcgtgagatgggttttcgtgaagcgtggaaggacgatccgcgtaaagtggaatacctatatgccaacagctatgaacgcgaagccgcaggtgtgttgtttgctgaatggctgaaaacgcacccaatgccacaggcactgtttaccacgtcattccaacttttacagggtgttatggacgtcaccctaaaacaaagtggccgcttacccagcaatctggccattgcgacttttggtgataacgagctgttagatttccttgaatgcccagtattggcagtggcacagcgccatcgtgatgttgctgaacgggtgctggagctggtattggccagtctggatgaaccccataagccaaaaccggggttaacgcggattcgccgcaatttattccgccgtggcactctaagcctaagccgcaggtagttcactataacgaatcagggcacccgccctgattttgattgctgacaaaccccgataacgcgatctgaagatgctgaggataggccggggagccaagtgtccgcgccataaaagataacgaacaggtagatcaaacataacctgcaacgcggaatagccggcgacaatattccaaaaaatagccgtaggccacccccataaccattgaaaccacggcgttactggcgaccgctgatatcatttgctcgaaatctgccccaaccgaccacaaaatcatggcataaaccggtgactggaaactgacataagctaatagatcagccaaattacgtgcccaaaaacgctggccagcatggcgctgggcaaaacgtataaaagcatctcgatacataccataaggccaggcaataagaatattgacgggtattgagagcaggcgcgaagaaagcgattgccggaaggtcattcccgagataaccacttcaattgccatgccgatgacaaaacaatacacgacgagtgcaaaggtatcggctacagcgctacgccaacgaggcccagttgaaaacattgtcataaactccatgcttgggagataaatctgccaaaaagctttttatcaaaatcattagttggttttatattttgattattatttaaatatagggttattgtgtcgtgattttgttttattggtagtttacattactgaattggttaatataaccagcataaaatttttatttttaacatttgactgatttttatactttatcctgtggggaaatgtcctttttttggtgattaaaacaaaaattaataggatttcctttaaaaaacagttggttgttgtttctgtgaaaaacgccggtattttctgccgtttaagccaaactgcaaacagaagaagataaaaaacacacatatttagccagactgctgacaaaccccgatgacgcgatcttgaacggtgaggataggcagaggagtaaagcgtccgcgccaaggatggcgcggctcgagcctacatggatgtatttacggcgtctttacgatctgcctgttctctccgtcgcgggcactttgtcaataacctcatatttaacccgtttttttaatttaagagttatctgtccgaagagattcatatttcaatcgtgacaaaaaatacgcactaataatttatttcaaaatagataaatctctcgtcagctaattgaagtaaaatgacgccgttgtaatgctggttatctacaagggtattattgtgtcagcgtggttttgagcctcattgactgctagcgcgctttagggaagaccagtagtcacaggatttgcactcagtttgctccatttcgaatagtgtaattttcatactgaaagtgagaccttccttgcagaaggaaataatgagacaattaattgacaatttattatttatttaagtagccagaattactggcggaaaaatagcccgtttatcatgacgttattttctatttcatcccttaaaatatccccttctatgggatatatcgcaaaaacaacccataaatattgttaaaccgcatcggctctggcttgacaaggttttcataccatccgtaaactcttaaatgtggggatttgtggggtaaagtggtgaattgggtcgtgaaggggtaactcagtcatgtttcgtggtgcaacaatggttaacctcgacagtaaagggcggcttgccgtacctacccgttatcgggagtcactgaatgaggaatcgcaaggccagatggtctgtaccatagaccttcaccaaccatgcctgttgctttacccactgcctgaatgggaaatcattgaacaaaagttatcgcgtctgtcgagcatgaaccctgctgaacgtcgagttcagcgtttgctgttagggcatgccagtgaatgtcagatggacggcgctgggcgcttactgattgcagggacattgcgtcagcacgccgggctaaacaaagaagtgatgctggttgggcagttcaataaatttgagctgtgggatgaacagacctggtatcaacaagtcaaggatgacatcgacgcagaacagtcaactcaggaacctttgtctgagcggctacaggacttatcgctataagtatggtagacaacaacaaaacggtagataacaactacaaacataccagtgtattgctggatgaggccgtaaagggcctgaatatccgtgataacggtatctacattgacggcacttttggccgcggcggccattcgcgtttgattttgtcccaacttgggccagaagggcgcttaattgcaattgatcgggatccagaagctatcgaagcggcgaaacagatcaccgacccccgtttctctatcgtacatggtcctttttctgatttagcacattatgtgcgggatctggatctcgttggccgtattgacggcatattgctggatttgggcgtttcatcaccacaacttgatgatgctgaacgcggcttctcttttatgcgtgatgggccgctggatatgcggatggacccttctcgtggcctgtctgctgctgaatggctgatgaaagccagcgctgatgacattgcctgggtgctgaaaaccttcggcgaagagcgctttgccaagcgtttggccaaggcgattgttgagcgtaacctcactcagcccatgacacggaccaaagagctggctgacctgatcgctaatgccagtccgtttagggataagcataagcatccagccactcgtagcttccaggctatccgtatttacattaacagtgaattggaagagatcgaacgtgcactcgatggcgcgcacgaggttttggcgcctgaaggccgtttgtcagtgatcagcttccactcccttgaagatcgtattgtgaaaaactttattcgtcatcatagccgtgggccacaggtccccgcaggcttgccattgacggaggcacaactgcgcagcatgggagggcgcacactgaaatcggttggcaaaatgatgccaggggatgcagaaattgctgaaaacccacgcgctcgcagctcggtactccgttttgctgagaggattggtgagtgataggcaacgagcgtcatggtttagtcggggtcattggggcagatcttatccgcaatgccaaaatcccattaatcctactggtcgcggtgttgatctctgccgtgctcgtcgtgaccacggcgcatcgtactcgcttactgaccgccgagcgtgagcagttggtattagaaagggatgcgctggatattgagtggcgcaacctaattttagaagagaatgcattaggcgatcacagccgcgttgaaagtatcgctattgaaaaactgaaaatgcagcatgtcgatccatcacaagaaaacattgtgattaaataataggttgttttttaaccaatacaggaatcagtgaccatcatgactcgcagtcgccaaggtaatacatgaagacagcgcgccccgggaagttaaagcgtcaggaagaacaagccagctttattagctggcgttttgcgttgctgtgcggttgtattttactggcattggttgggctgattatgcgtaccgcatacctgcaagtgatcaaccccgataagctggtgcgcgagggggatatgcgctcgctgcgagtacaagaggtgccgacggcgcgtggcatgataagcgatcgctctggccgccctttggcggtcagtgtacccgtcaatgcggtttgggccgatccaaaagaactgattgaacagggggggatctctctggatacccgctggaaagccctgtcggatgcattagaaatccctttagatcaacttgccacgcgcattaatgccaatccaaaaggccgctttgtctatctggcccgtcaggtgaaccccgcgattggcgactacatccgcaagctgaaattacccggtatccatctacgtcaggaatcccgtcgctactatccggcaggtcaggtgatggctcacattattggtgtgaccaatatcgatgggcaagggattgaaggtgttgagaaaagttttgatcgctggctcaccggccaaccgggcgagcgaacggtgcgcaaagaccgttatggccgtgttattgaagatatctcctctgttgacagccaggcggcgcataacctggtgctgagtgtggacgagcgtttgcaggcgttggtgtaccgcgagctcaataatgcggtggcgtttaacaaagcagaatcgggcacggcggtattagtcgatgtgaacaccggtgaagtcttggcgatggcgaacagcccgtcttacaacccgaataacctaaccggtacgccgaaagacgcgatgcgtaaccgggcaataaccgatatttttgaacccggctcgacagtcaagccaatggtagtgatgacggccttacagcatggtgttgtgaaagagaacagtgtgctgaataccttgccgtactttgttaacggtcaccagattaaagacgtggcccgttacgctgagctatccgtcactgggatcttacagaagtcgagtaacgtcggtgtttctaaactggcgttagcgatgccatcctcagcgttagtagatacttactcacggtttgggtttgggaaagcgaccaatttggggttggtcggagaaagcagtggcttatatcctaaaaaacaacggtggtctgacatagagagggccaccttctctttcggctacgggctaatggtaacaccgttacaactagcgcgagtctatgcaaccatcggcagcatgggggtctatcgcccgctgtcgataacccgagttgacccacctgtcgccggtgaacgcatcttccctgaacccctggtacgcaccgtggttcatatgatggaaagcgtggcactgcctggcggtggtggtaccaaagcggcgatcaaaggttaccgtatcgcgattaaaaccggtacggccaaaaaagtcggtcccgatggcaagtatatggatcgatacctcgcttacaccgctggcgttgcgcccgcgagtaaccctcgatttgctctggttgtggtgatcaatgacccacaggcagggaaatattacggtggtgcggtttctgcaccggtattcggtgccatcatgggcggcgttttgcgtaccatgaacattgagccagatgcattacccaccggtgataaaagcgaattagtgattaatacaaaagagggttcaggtggcagatcgtaatttgcgcgacttattcgctccttgggggctagacgtcccggagcgggcgctacgggaaatgacattagacagccgtattgcagctgccggcgatttatttgttgcggttgttggccaccagacggatgggcgtcgctatatcccgcaagctatcgcccagggtgtggctgcaattgtggccgaagccgatggtgtcgcaccggatgtcagcgttgccgagatacatggcgtccctgttatttatttgcgtaatttgaatcagcacttatccacgctggctgggcagttttaccatcagcctggcgccgcattgcgtttggtcggtgtaaccggaacgaatggcaaaaccaccactacgcaattgttagcacaatggagccaggcgctgggcgaaaccagtgcagtcatgggcaccgtaggtaatggtttattagggcaggtgatacccacggagaacaccaccggttctgccgtagatattcaacatttgctgcgtaatctggttgatcaaggtgcgacttttgccgccatggaagtttcttcccacggtttgattcaagaccgtgttgctgcgttaccctttgcagccgtagtgttcactaacttaagccgcgatcatctagattatcacggcaatatgacgagctatgaggcggccaaatggctgctgttctccactcatcagtccgaacacaaaattattaatgctgatgatgacgttggccgccgttggttaagccaattgccgcaggctgtcgccgtcagcatggcaggcaatgtccccaaaggctggaatggcccgtggttatctgccaacaaggtgatttatcacgataatggtgccagcatcgcgtttgattcaagctggggcgaaggcgagctagaaagccgtctgatgggcgctttcaacgtcagtaacttgttggtggcattagcgacgttactggttcaggggtatcccatggcgcagttgttagctgcagcgcctcatctgcaaccggtttgtgggcgtatggaagtgtttaatgcgccgggtaaaccaaccgttgtggtggattatgcccacacgccagatgcattagaaaaagccttggccgccgcccgtttacattgcaccggcaagctgtggtgtgtgtttggctgtggcggtgaccgtgataaaggtaagcgcccacttatgggcggtatcgcagaacaactggctgactgtgtcgtggtgaccgatgataacccacgcagtgaagagccacaggcgattgttgctgacattctcagtggcttgctggacgcggggcgtgtgcaggcgatacatggccgtgccgaagccgtaaccagtgccattatgcaagccaaagaagacgacgttgtcctgattgccggtaaaggccatgaagattatcaattagttggcaatcgtcgcttggattattcagaccgtgtcaccgtcgcgcgtttgttaggggggcaggcatgattaaggtctctctgcgttttctggctagcttacttaatgctgaatatatcgttgctgaatcagtcagcgatgatattgagataactgaagtgaccattgatacccgtaaggtcactgctggttgtctgtttgttgcgctgaaaggcgagcgttttgatgggcatgattttgccgaagatgctattgccgcaggtgctggcgctttgctggtaagtaaacgcttactggtgggggggccgcagttagttgtcaaagacacgcgcttggcgttagggcaatttgcggcttgggttcgccagcaagttccggctcggatagtggcattaaccggttcatcgggtaaaacctcggtaaaagaaatggcggcagcgattttgcgccaatgcggcaatgtgctgtataccgccggtaactttaataacgatatcggtgtcccgctaacattgctgcgcctaacggccgaacatgattttgctgttattgaacttggtgccaaccatgttggtgaaattgcctacaccaccgatttaagccgtccagaaagcgctttggtgaataatttagccgccgctcatctggaggggtttggttcgctggccggtgtggcgcaagccaaaggtgagatcttcgctggcttgcctgccaatggcacggcgattatcaatgccgatagtaacgactggccgcactggcaagaaacgctacataacaaacgggtttggcgtttctcgccccacgccgcagaacatattgatttctatgccagtgatgtgcggatcacgcctcaactcacctccttcactttgcattcaccgtttggcaccgtggctatcgaattgcctctaccggggcagcataacatcgccaatgcgttagcggcggcagcattagccatgtcggttggggcggatttagccgcagtacgccaagggttggcgcagttacaagcagtacctggccggttattccccgtcccattagcggaaggcaaattgctgttggatgacagctataacgccaacgtgggttccatgattgccgccgcacaggtcttggccgagatgccgggttaccgggtgatggtggtcggtgatatggccgagttgggcgaaaccgcggcagattgccatcgtcaggttggtgaagccgcgaaactcgcaggcgtcgataaagtattaagcgttggcacattgagccagatactgagcagtgcgagcgggaatggcgaacactttcaggatcaaaatacattgagcacccgtgtaaacgcgttgctgaacgaatatccggttatcactgttttaattaaaggttcacgtagcgccgctatggaaaatgtcgtgcgtgcgttacaggagaaggcatcatgttagtttggttggctgaatacttagtgaaattttactcaggctttaacgtcttttcctatttgacgttccgcgccatcgtgagtctattaaccgcactgtttatttcattgtggatggggccgcacttgattgcctggttgcaaaagctgcaaatcggtcaggttgtgcgtaacgatgggccagagtcgcatttcagtaagcgcggtacgccaaccatgggcggcctgatgatcctcttctccatcaccatttcggttctgatgtgggcttatccctctaacccatatgtctggtgtgtgctgttcattcttataggttatggcatcgtcggttttattgatgattaccgcaaagttgtgcgtaaaaacaccaaaggtttgatcgcgcgctggaagtatttctggcagtcaattattgccttggctgcggcattcacgatgtacagcattggcaaagatacctcggccactgaattagtcgtgcccttctttaaagacatcatgccgcaattgggcttgctgtatgtcctgctggcatatttcgtgattgtgggtaccagtaacgcggttaacctgacggatgggctggatgggttggcaattatgccgacggtgttcgttgcggcaggttttgccttagtcgcttgggcaaccggtaatgtgaactttgccgcttatctgcatattccttacctgcgccatgcgggtgaattggtcattgtctgtaccgcgattgtcggtgcgggtttaggtttcttatggtttaacacctacccggcgcaagtgttcatgggcgatgttggctcactggcactgggtggcgcattaggcactatcgccgtattactgcgtcaggaattcttattagtcattatgggcggggtcttcgtggttgaaaccctgtccgttatcttgcaggttgggtcctttaagttacgtgggcagcgtattttccgcatggctccgattcaccatcactacgaactgaaaggctggccagaaccacgggtgatcgtgcgtttctggattatttcgctgatgctggtgctgattggcctggcgacgctgaaggtgcggtaattatggttgattatcagggtaaaaaagtggtcatcatcgggctggggctaaccggcctttcctgcgttgatttctttatagcgcgtggtgtcacgccgcgcgtgatggatacccgcatcaatccaccgggcttagatcaattacccgaaagtgtcgaacagcatgtgggtgatttgaaccaagaatggctactggacgctgatttaattgttgttagccccggtatggctctggcacatcctgcattaagtgaagccgccgaggccggtgtcgagatcattggcgatatcgaactgttctgccgtgaaaatcaggcaccggttgtggctatcactggctccaacggcaaaagtaccgtgacgacgctggtcggtgagatggcaaaagcggcaggttggtcagtgggggtcggcggcaatatcggcgttccggcactgacattgctgaagcaagataaccaattaactgtcttggaattatcaagtttccaactggaaaccacccacagcttgcgggcctctgctgcgacgattctgaacgtgacggaagatcatactgaccgttatccactcggtttgcagcaataccgtgcggcgaaactgcgggtgtatgaaaatgctaaggtttgtatcgtgaatgccgatgatgcactcaccatgccggtccgtggtgctgatagccgttgcatcagttttggggtcgatgtcggtgactaccacctgaataagcagcagggtgaaatttggttacgggttcgtggtgagaaagtgctgaacacccgtgaaatgaaattaagtgggcgtcataactataccaatgcgctggccgccctggcattagctgatgccgtgggtatcccacgggcatccagtttgaaagccttgacgaccttttccggcttgccacaccgcttccaattggtgcttgagcgccatggtgtgcgctggatcaacgactccaaagcgaccaacgtgggcagcactgaagccgcgctggatggtttacaggttgatggcaccttgcatttattgttggggggcgacggtaaatctgctgatttctccgggttaacgcgcttcctgcaaggggatcgcatcaaggtctactgttttggccgcgatggcggtcaattggctgcgttgcgccctgacgtctctcaacttaccgagacgatggcgcaggctatggcgttggtggcaaaagttgtgctacccggcgatagggtgctgctgtcacctgcgtgtgccagcctggatcaattccgcagctttgagcatcgtggtaatgagtttgctcgtctggcagaggagttaggctgatgcgtatgccggggctggggctgtttaataccttaaaacattatgtcatggggtcgcgggagagcgacaccaccagcatggtgctttatgacagaaccttgctgtggctgacatttggtttggcgattattggttttgtgatggtgacgtcggcgtcaatgccaatcggtcagcgcttggctaatgaccctttcctgtttgctaaacgtgacgcgctctatctggcattagcgtttggtttgtcactggtgacgctacgtattccgatggatgtctggcagcgctatagcaatatcatgttattgatttccattgttttgctgctcgttgttttggtggttggtagctcggtaaacggggcatcacgttggattgcactagggccattgcgtatccagccggccgaattatccaagttgtctctgttttgttatttggccagctatctggtgcgcaaggttgaagaagtccgtagtaacttctggggtttttgtaaacccatgggcgtgatggtcattctggcggtgctgttgctggcccagcccgatttaggaacggtggtggtgctgtttatcaccacgctggcgatgctgttcctggcaggtgccaaaatgtggcagtttatggcgattatcggttctggtgccttcgcggtttgtttgctgattatcgccgagccttatcgtatgcgccgcgtaacatccttctggaatccgtgggccgatccctttggcagcggctatcagttaacccagtcactgatggcatttggccgtggtgagttttgggggcaaggtttaggtaattcagtacaaaaactggagtatttaccggaggcgcacaccgattttattttctcgattttaggtgaagaactcggctatttcggtgtggttttggccctgttgatggtattcttcgtcgcttttcgcgcgatgtccattggccgccgtgcattggagattggtcaacgattctctggctttttggcttgttcaattggtatctggttcagtttccaggcgctggttaacgttggtgccgctgccggaatgttgccgacgaaaggtctgacgttgcccctgataagttacggtggttcaagcctgataattatgtcaacggcgatagtgctgttgttacgtattgattttgaaacgcggctggcaaaagcccaggcgtttgtaaggagtgcccgatgagtgggaagaccaagcgtttgatggtgatggcgggtggaaccggggggcatgtcttccccggtttggccgtggcacatcatttgatggcgcaaggctggcaggtgcgttggttaggcactgcggacagaatggaagcgtcactggttccccaacatggcattgaaattgattttattaaaatttccggcttgcgtggcaaaggtctaatggcccaattgacagcaccgatacgtatttatcgtgcggtgcgccaggcgcagaaaatcatgcgagattaccaacccgatgtggtgttgggcatgggcgggtatgtttctggccctggtggtttagccgcctggctgtgtggcgtaccggtggtattgcatgagcagaatgggattgcgggtctgactaaccgttggttggccaggatcgccaaaaaagttttacaggcatttccaggggcattccccaacgcggatgtcgtgggtaacccggttcggaccgatgtactggccttgccattacccgcagtgcgtttgagcggccgtgaagggccgattcgggtcttggtcatcggtggtagccaaggcgctcgaatactgaatcagaccctgcctttggttgctgcaagtctgggcgaacaaataacgctgtggcatcaggtcggtaaaggcgcactgccagaggtatcgcaggcttaccaacaagcggggcaggccgggcaccaagtggttgaatttatcgacgatatggcagcggcttatgcctgggctgatgtcgtggtgtgccgttcaggtgcactgacggtcagtgaagtggcggcggcggggctacccgcgatttttgtgccattccagcataaagatcggcagcaatattggaatgcattgccgctagagaaagcgggggcagcaaaaattattgagcagccacaatttacggcaaccagcgttagcagcctgctggcgggttgggatcgtgcaacattactgtcgatggctgaacgggccagatcggttgccatccctgacgcgactgagcgtgttgcggctgaagtggttgcggccagtaagtcagcgtaaaatcgcgatcactttgaaatagctacaattttaaatggttacggttttgaaatagcgatgaccttgaaataaacagtgatcagtgggcgatgaatgcaggctgtgaatacatgacagacaaaaaagtgaagagaaacgtgaatacacaacaactggcgaaactgcgtactatcgtgcccgagatgcgacgtgtccggcacattcactttgttggcatcggtggtgccggcatggggggtatcgccgaagtgttggccaacgaaggttatcagattagtggttcagatttagcacccaactcggtaactcagcatttgactgccctgggtgcacagatttatttccatcatcgcccggaaaacgtgctggatgcgagcgtggtcgtggtttctactgcaatctctgcggataacccagagattgtcgcggcccgtgaggcgagaataccggtgatccgccgcgcagaaatgttggcggaattgatgcgctatcgccatgggattgccgttgctggcacccacggcaaaaccaccacaacggcgatgttatccagtatttatgccgaagcagggttagatccaacgttcgtcaatggtgggttagtcaaggccgcgggtacacatgctcgtttgggttccagccgttacctgattgcagaagccgatgaaagcgacgcgtcattcctgcatttgcaaccgatggtggcgattgttaccaatatcgaagccgatcatatggatacctaccaaggcgacttcgaaaatttaaaacagacattcattaactttttgcacaatttgcccttttatggccgtgcggtgatgtgtatcgatgatcccgtagtgcgtgaattattgccacgtgttggccgtcacatcacaacctatggtttcagtgatgatgctgatgtgcagatcgccagctatcggcaagaaggcccacaagggcacttcacgttgcgccgtcaggataaaccgttgatagaggtgaccttgaatgcaccaggtcgccacaatgcactgaatgcggcggcagcagtcgctgtcgcaacagaagaaggcattgaagacgaagatatcctgcgtgcattagtgggtttccaagggacggggcgccgttttgatttcctcggcaacttcccactggccccggttaacggtaaagaaggcagtgcgatgctggttgatgattatggtcatcaccctaccgaagtggatgccaccattaaagccgcacgtgctggttggccggataaacgcattgtcatgctctttcagccacaccgctatacccgaacccgcgatctgtatgacgatttcgcgaatgtgctgtcacaggtcgatgttttattgatgctggatgtgtatgccgcaggtgagccaccgatcccaggggcagatagccgcgcgttgtgccgaacgattcgtaatcgcggtaagttggaccctattttagtgccagacagcgaatcagcacctgaaatgttggcgcaaatactgaacggggaagacctgatcttggttcagggcgcaggtaacattggtaaaattgcccgtaaattggctgagcataaattgcagccacagttaaaagacgaggaacatcatggctgagaaagtcgcggtattgctgggtgggacctctgcggagcgtgaagtgtcattactgtcaggtcaggcggtattggcaggcttgaaagaagccggtatcgatgcttatggggtggataccaaagattttccggtaactcagcttaaagaacagggctttgataaagtgtttatcgccctgcatggtcgtggtggcgaagacggtacgttacaaggcgtattggaatttctacaactgccatataccggcagtggtgtaatggcatccgccctgacaatggacaaattgcgcaccaaattagtctggcaagccttggggttgcctatttcgccttatgttgcgttgaatcgccaacagtttgaaacactttccccagaggaattggtggcgtgtgtcgctaagcttggcctgccacttattgtcaagccaagccatgaaggctctagcgttgggatgagtaaagttgatcacgccagcgaattgcagaaggcattggttgaagctttccaacatgacagcgatgtactgattgagaaatggctgagcgggccagagtttactgtcgcgatccttggggatgaagttttgccttctattcgtattcagcctccgggcgtgttttacgattatgacgctaagtatttgtcagataaaacacaatacttctgcccaagcggtttaagtgatgagtcggagcaacaattggcagcgctggcattgcaggcttaccacgcgctggattgcagcggttgggggcgggtcgatgtgatgcaagaccgcgatggtcatttttacctgcttgaagtgaacacttcaccgggtatgaccagccatagtttggttccaatggccgcccgccagtatgggttgagtttctcccaattggtggcgcgtattctgatgttggctgactgatatgtcgcaagctgccttgaatgcgcgagagcgtgcggcggagaaaaatgcagcccggcgcagtaacgggagccaattggcaggggtgatttttctgctgatggtcctgggaaccatactctggggaggctgggtcgttatcggttggatgaaagatgccaaccggctaccactgtcgaaactggtggtcaccggtgagcgccattacaccaccaatgacgatattcggcaggcgattctggcattgggcgcaccaggtacgtttatgacgcaggatgtgaatatcatccagcagcagattgaacggttaccttggatccagcaggccagtgttcgcaagcaatggccggatgaacttaaaatccacctggtggagtacgtgcccttcgcccgttggaatgacttgcatatgattgatgagcaggggcgatcatttagcgtgccttctgagcgaatgggtaaacaggtattgccactactgtatggccctgaaggcagtgagcgggatgttctggaaggttatcgagcaataaataaggtgttaacggccaataaatatcagctaaaaatggtggcgatgagtgccaggcattcttggcagttggctttagataatgatgttcggctggagctggggcggagtgaccgaatggggcgtctgcaacgtttcatcgagttatatccgatgttgcaacagcagccagataaacgggtcagttatattgatttgcgttatgacactggggcttcagtaggttgggcaccggtctttatcgacaatcagggtggagaaccaccgattaatggccagcagaacagtaatccgtaacaaaatcaggcacaggcaaaacaacaatgatcaagtcgacggacagaaaactggtagtaggtctcgagatcggaacggcaaaggtctccgcattggtaggggaagttctgcctgatggcatggtcaatattattggggtaggcagttgcccatcccgtggcatggataaagggggcgttaacgaccttgaatcggtagtgaaatgcgttcagcgcgctatcgatcaagcggagttaatggcggattgccaaatttcctctgtttatctggcattatcgggtaaacatatcagttgccagaatgagatagggatggttcctatttcagaagaagaagttactcaggaagatgttgagaacgtagtgcataccgcgaagtcagtacgtgtgcgtgatgaacatcgtatcctgcacgttataccgcaggaatatgccatcgattatcaggaaggcatcaagaatcctgttgggctttctggcgtgcggatgcaagccaaagtgcacctgattacctgccataacgatatggcaaaaaatattgttaaagcggtggaacgttgtggcctaaaagtggaccaacttatctttgctggtttagcagcaagttatgccgttttgaccgaagatgagcgtgaactgggggtctgtgttgtcgacatcggcggtggcaccatggatatggcggtttataccggtggggcattacggcacaccaaagtgatcccctacgccgggaacgtggtaaccagtgatattgcttatgctttcgggacaccgccaacagatgcggaagcgattaaagttcggcacggctgtgcgctcgggtcgatagtcagcaaggacgaaagtgttgaagtgccaagtgttggcggacgccctcctcgtagtttgcaaagacaaacactcgctgaggttattgaaccacgctacaccgaattgctgaatttagttaatgacgagattttacaactgcaggagcaattacgtcagcaaggcgtaaagcaccatctggcggcaggtattgtgctaaccggtggcgctgcacaaattgatggtttagcggaatgtgcacaacgggtgttccatgcccaggtccgaattggtcagccgcttaatatcaccgggctgacggattatgcgcaggagccttattactccacggctgttgggttattgcattacggtaaagaatctcatctcagtggtgagtcagaagtagaaaaacgtgcctcagtgggcaattggttcaaacgtatcaatagctggctgagaaaagagttttaatgtttcaacaaagagatcaagctgaacttattttttgatctcgaagcgacaggcacaaaacggagagaaactatgtttgaacctatggaactaaccaatgacgcggtgattaaagtcatcggcgtcggtggtggcggtggtaatgccgtcgaacacatggtgcgcgagcgcatcgaaggtgttgaattcttcgccgttaatacagacgctcaggcgctacgtaagacggctgttggccaaaccatccagatcggtagcggtattaccaaaggtttgggtgctggcgcgaaccctgaagtgggccgcaattcagcagaagaagaccgtgaagctctgcgtgcagcgcttgacggtgcggatatggtctttatcgcggctggcatgggcggtggtaccggtacgggtgctgcacctgttgttgctgaagttgcgaaagaactgggtattctgacagttgctgtggttaccaagccttttaattttgaaggcaagaaacgcatggcatttgctgagcagggtattgctgaactgtccaagcatgtggactcactgatcaccatcccgaacgataagctattgaaagttctggggcgtggcatctctttactggatgcatttggtgcagcgaatgacgtgctgaaaggtgcggttcaggggattgcggaactgattacccgccctggtctgatgaacgtcgacttcgcggatgtgcgcacagtcatgtccgaaatgggttatgccatgatggggtctggtgtcgcttgcggtgaagatcgtgcggaagaagcagcagaaatggccatctccagtccgttgctggaggatattgacctgtctggtgcccgcggcgtgctggttaacatcacggcgggtttcgacttgcgtttggatgaattcgagaccgtgggtaacactatccgtgctttcgcgtctgacaatgcaaccgtggttatcggtacctcattagacccagaaatgaacgatgaactgcgcgtgacagtggttgctaccggtatcggcatggataaacgtccagaaatcacactggtgactaacaagaaaactcagcctgtgatggaccaccgttaccagcagcatggcatgtcacctttacctcaggaagtgaaacctgcggctaaagtggtcaatgacaccactgctcaaaccaataaagagcccgattatttggacatcccggcgtttttgcgcaagcaagccgattaatttccgaatatttggaatctccgctctttgtgctaaactgtcccaccgatcttgttataagcttggtcggtaggatggataacattgcgagataaaatgatgatcaaacaaaggactttaaaacgtattgttcaggcgacgggtgtcggtttgcacaccggtaaaaaagtcacgctgacaatgcgacccgcgccggctaataccggggtcatctatcgtcgcactgacttgaatccaccggttgattttccggcagatgcaaaatccgtgcgtgataccatgctctgtacttgcctggtcaatgagcatgacgtgcgtatttctactgttgaacatctcaacgctgctttggcagggttagggattgataacattattattgaagttaacgcccccgaagtaccaatcatggatggcagcgccagtccattcgtgtacttgttgctggatgccggtattgaagagttaaactcagcgaagaaattcctgcgtttgaaagagacagtacgggttgaagatggtgataaatgggctgaattgtctccattcaatggattccgtttggactttaccattgattttaatcacccggcgattgactcaagtacacagcgttattgcttagatttctcggccgattctttcgtccgccaaatcagccgtgcgcgtacttttggtttcatgcgtgatatcgaatatctgcagtcccgcggtttgtgcctgggcggtagtttcgattgtgccatcgtggtagatgattaccgcgtattaaatgaagatggcctacgctttgaagatgagtttgttcgtcacaaaatgttggacgctattggcgacctgtttatgtgcggccataatattattggcgcatttacggcgtacaaatctggtcatgccttaaataacaagctgttgcaggctgttttagcgaagcaagaagcttgggaatttgtgacgttccaagatgaagctgaaatgcctttggcattcaaagcaccgtctacagtattagcttactaaatatacttgtacccaaagtaattgggagttgaagtaattgaagttgtagccagacagcgaacgaacagaacctgctgagctgatgtaaatcagtgattcgggtgaatggaacagctaccgcaccgttgatgcaaacagggctgcaacttcaagtaagaaaagtaagctacttatcacgcttggttgcgttggcaccctctccggccaacgcagccagtcgttccaagatcactctcagtttttcagggctacggctcgctaatcctcttagttccttagcactttccaagcttaagtggcgtactggcggtgattttacacgatcttgcggcgattttgcggcatcttgtgtcacgttatggcctttcgccattaacgatggattaatcctgatgtcgattgaagacaatgatggtagaatttgcgctcgtagtgcggatagcaacgcaggttgttcgtaacgtaagcgcatcaaccaactggcattcgctgtctctagcactaaaacactctgtcgatagtttgcgacacggcaccacggctgtaattgtgaagggagtaatccttttaccgcacggttaagttttaacagtgcagtcgcgcgttgttgtacgttatgtagcggtccgttttctgctgcaaccgcatcatcgaacagaacatctaataattgtgggcggttttcacgcattgacaaggctccggcggattttaaactcgtgatcggtattctaaatcgttggcgacaatttggcagacgttatttctggccgcatctcctgttggggatggtcgcggcgagtcttggtgtgccatcaaatctgtctggcgttccagaccatgcggcattagcgaacacatcatccagccaaagtcgtcagaatcatggtacgacaaacttcaacagtttggcactgttgcatgacatacaccgtcgcccctcattcagtgtagattactggcaacagcatgccctgcgcacggtcatccgtcacctctcttttgctctggcaccacaagcggcatatgcacgcgtacaagaagtcgccgaaacagaacgggttgctccatcaaaaattcagcaactcgcgttactggatacgctaaatgcactactgacgcatgaatttaagccaccggccattattcgctatacagaacaggttgaacggcctgttctgtcgccatataaacctgggctctggcttgctcaagtacaaggtattcgtgccggtcctgccaacttaagctaattattctcttggtttatcccaattttatacaacctttggccgccggtttggtggtcttgtaagagatattaagaatcatgctaattaaattattaaccaaagtttttggtagccgtaacgatcgtactctgcgccgcatgcaaaaagtagttgatgtcatcaaccgcatggaacctgatattgaaaaactgacagacaccgaattgcgcgctaaaacggatgagttccgtgagcgtttagcgaaaggtgaagtgttggaaaacttaattcctgaagcctttgcggtcgttcgtgaagcgagtaagcgtgtgttcggtatgcgtcacttcgacgtgcaactgctgggtgggatggttctgaatgagcgttgtatcgcagaaatgcgtacaggtgaaggtaaaaccttgaccgcaaccctgcctgcttacctgaatgcgttgagtggccgtggcgtgcatgtggttaccgtcaacgactatttggctcaacgtgacgccgaaaataaccgccccttgtttgagtttttggggctgagcattggtatcaatttaccgaatatgactgcgccagccaaacgcgcagcctatgccgctgatatcacttacggtaccaataacgaattcggtttcgactatttacgcgataatatggcgttcagtcctgaagagcgtgtgcagcgtcaacttcactatgcgttagtcgatgaagtcgactccatcctgattgatgaagctcggaccccgctgattatctccggccccgccgaagacagttccgaaatgtatattcgggttaacaaactgattccaaaactgattcgtcaggaaaaagaagactcggacagcttccagggggaaggtcacttctcggtagatgagaaatcacgtcaggttcatttgactgagcgcggtctgattctgattgaacagatgttggttgaagcgggcatcatggatgaaggcgaatcactgtattcgcctgctaacattatgttgatgcaccatgtcacggccgccttgcgtgctcatgtgctgtttacccgtgacgttgactatatcgtgaaagacggtgaagtgattattgttgacgaacatactggtcgtacgatgcaaggtcgccgctggtctgatggtttgcatcaggcggttgaagcgaaggaaggcgtggaaatccagaatgaaaaccagacactggcttctatcactttccagaactatttccgtctctatgaaaaactggctgggatgacgggtaccgcagataccgaagcatttgaattcagctcaatttacaagttagatacgattgtcgttccgactaaccgtcctatgatccgtaaggatttggctgatctggtctatatgaccgagcaggaaaagatcggcgcgattatcgaggatatccgcgaacgtacagcgaacggccagccagtgttggtcgggaccatctcgattgaaaaatccgaggttgtctctgcggagttaaccaaagccggtattgaacacaaagtgttgaacgctaaattccatgccatggaagcagagattgtttctcaggccggtcagccaggggcggtaaccatcgccacaaacatggcgggtcgtggtactgacattgtgctcggtgggagctggcagagcgagattgctgcgctggaagatccaactgaagagcaaattgcggcaattaaagccgcttggcagattcgccatgatgcagtattggcatcgggtggtttacacatcattggtaccgagcgccatgagtcacgccgtatcgataaccagttacgtggccgtgcgggtcgtcagggtgatgcgggttcttcacgcttctacttgtcaatggaagatgccttgatgcgtatttttgcctctgaccgtgtgtctggcatgatgcgtaaattgggtatgaagccaggtgaggcgattgaacatccatgggtgaccaaggccattgctaacgcacaacgtaaagttgaaagccgtaacttcgatattcgtaagcaactacttgaatatgatgacgtagcaaatgatcagcgtcgggctatctacagccagcgtaatgaactgctggatgtgtctgatgtcagcgaaaccatcaatagtattcgcgaagatgtcttcaaaaccaccattgacagctacattccgacccagtcactggaggaaatgtgggatatcgaaggcctggaacagcgcctgaaaaatgattttgacttagatatgccaattgctaaatggctggaagatgagccacaactgcatgaggaaaccttgcgtgaacgtattcttcagcaagctattgagacttatcaacgcaaagaggaagttgttggcattgaaatgatgcgtaacttcgagaaaggcgtgatgctgcaaacgctcgattccttatggaaagagcatttggctgcaatggattacctgcgtcagggtatccacttacgtggctatgcgcagaaagatcctaagcaggaatataagcgtgaatccttcgccatgttcgccgcaatgctggaatcactgaaatatgaagtgattagcgttctgagcaaagtacaagtgcggatgccggaagaggtcgaagcgctggaggtgcaacgccgcgaagaagcagagcgtttggctagacagcagcaactgagccatcagactgacaatagtgcattgatgtcagaagaagaggtaaaagttgctaacagccttgagcgtaaagtggggcgtaatgatccgtgcccatgtggttcgggtaagaaatataaacagtgtcatggccgcttgcagtaatacttgcgctaacctgtaatatagataaagggcggttaataccgccctgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagtagtctgagggcggttaataccgccctttatttttaagtttttttcgttaataagtcggtcactgaagcgccctgaccaggagaaaaaatgaaacacttacaaattgctgttgggatcattcggaactcgcaacaggaaatttttatcactcaacgtgctgctgattcccacatggctggcttttgggagttccccggcggcaagattgagcagggtgaaacacccgaaattgccttaaaacgtgaattgctggaagaaacggggattgtggtacaacaggcaactttattaacaatgctggaacatacttttagcgatagaatcgtcacattgcatttctatcgagtagaggtgtgggatggtgaaccctttggccgtgaagggcagcctatgcgttgggtattgcaatctgagctacgagctgacgaatttcctcccgctaatgccgcaattattgaattattaacaaaataattaactgcatagcgccgtggtacctactttattttaatggagcaagacgtccgtcgtttgctccattttttgtgcccagaaaacccccagctaggctgggggttcagtaaagctttcagctttgggtcagttataaaaaccccttttgatttgttaaaacagtttgcggtctggcaactgcaaatgttcaacaagaaatcaaaagggggtcccaatgagggatgaaaagagcttagcgcacacccgatggaactgtaaatatcatatagtttttgcgccgaagtaccgaaggcaggtgttctacagggaaaaacgcagagcgattggcagtattttaagaaaactgtgcgaatggaaaaacgtgaatatcctggaagcagaatactgtgtggatcacatccatatgcttctggagatcccgcccaagatgagtgtctcgggatttatggggtacctgaagggaaagagcagtctgatgctttatgagcagtttggcgatttgaagttcaaataccgtaacagggagttttggtgtcgagggtattacgttgatacggtagggaaaaacacggccaggatacaagaatacataaagcaccaattggaagaggataaaatgggtgagcaactctcgatcccgtatcccggtagcccgtttacgggccgtaagtaatccatagatgcaaatgtcagatcgcgatgcgcctgttagggcgcggctggtaacagagccttataggcgcatatgaaaaacctccggctatgccggaggatatttattaaaacacatcacgcttaagacgtatcgcagttaaagacatatctcggttaaagacatatcacagttaaaaatagacagcagttaatgcttaagaggatcttcctcactccattcgtcactgtcagacagttctgtatcgctagggatccgcttttcttcgtctgcccactcacctaaatcaataagctggcagcgcttgcaacaaaaagggcgaaaagggctttgttcaccccagataacgacttttccacaggtggggcagttaacctgtatttgttctgattccatgttctctcctaaaatctatcgatacccttcatctttcaagtggtagatgtgttggtttcaagtggtagatgtattagtttcaaatagtagatctattaggcagttcccgttcatccgtattatttgctgatgtcaatgatgcgggatttactcctttgccgccttcctacgccttgaaatctattgggtatcacacttattacaaaatcagcagcaggctaattcaaacgataaacgggccggaacggtgccattttcactatcaagcgctaaaaagcgaatggcataccgtgttttatggccggaaatttgtggatacagttgtggatcgagcggtagacgtaatctgagcaggtcagctcccccagcattatcctgaaagaaaccatttaaacttatctggctacgtaaagggcatgactggcgaattaagtccaaaatgatcgtcagtgactggtgaagaggggccagacttgctagcaatttattgatatgttggtctcgttgttctgacggttgatgtaaccagacatgtaacgtcggtaaatcaaaactacaacatcctccagggatactcaggcgctggcggaccacactgatcaagcgatcttcttttagtgactgcccgatacgcggggctgacattaatacggcggcacggctttttaactgattgcgcagagagtctactaatgacacgtcaacaccgggtatatcagcccattgctgtagtttttgctgttggcgctcgagttcttttaacagatcagtacggacttcaccgcgttcaagtacatcaattaaatccgatgcggtacggaaaaaggttaatgcattggcaatattatctaatgagcggtggctttctagctgttgtaataaaaactccattcttagccaagtgcgcatcttttcattgagcggatgttcaaaaagtattgttgaggtaaggtcactcattgatgtagatcctgttgggccgcagttgccaattttaagtaccgatggtgtagtgaggcaacatgctgggcgatcattaacgggtcgccgctattgtcaataatgtcatcagcacaggccaagcgttgttgccgcgaaacctgtgaagccaaaatattttctgcctgttggcgtgtaataccatctctcgccatggtccgtgcgagctgtatgtctggtgttacgtcgactactaacacacgatctgcccggtgatgtaaaccattttcaaccagtagaggcacaacccaaagggcataaggttgatcaataccggctaattggcgttgcgtttcctgctgaataagggggtgtaacagtgaatttaaccatgctttttcttgttgctcactgaaaattttttgtcgcaatgccgctctatttaatgagccatcttgctgcaaaatattttcaccataacgggatgcaatggccgctagtgcagatgtccctggttcaacaacctgacgagcaataatatcagcatcaaccaacggcacacctaaattggcgaatgcatttgccaccgtactctttccgctaccgatcccacctgtgagagccacaatataggtcattgcttcgccttatttactgccattggatgggagaattgtatctgaaagcttgggcgaaggcatagccaaggtatgcattctatctgtatggcgcagtaaaataagcggagaaaactcacggataagagcgtggtcagtaatattcaggtaatttgtgggattgtagcgcaaataaaggttaattcgcagtcttgccgaagaattattcatgcgtatgatagctccactgggatggcgtgttttacgcccgatcacattttgcgatctatcgccaataaccagggaataataagtcatgcgcattgaagaaggtttgaaattaggctttaaggatgtgttaatccgtcctaaacgttcaacgctgaaaagccgttctgaagttgctctggaacgtcagtttactttcaaacattcaggttggaattggtctggtgtccctatcatagccgctaatatggataccgttggtaccttccgcatggctgaggttttggcttcatttgatattcttactgccgttcacaagcattacactctcgaacaatgggctgagttcgttaagcgctcaccagaatcagtgttacgccatgtcatggtatcaacgggcacttcctctgctgatttcgacaaaatgaaacaaattttggcgttatcaccatcattaaaatttatctgtattgatgtcgcgaacggctactcagaacactttgtttctttcctgcaaagagcgcgtgaagcttgtcctgataaagtcatttgtgcgggtaatgtcgtgacaggtgaaatggtagaggaactgatcctctctggtgctgatatcgttaaagtcggtattggccctggttctgtttgtaccacccgtgttaagactggcgttggctacccacaactgtctgctgtcattgagtgcgccgacgctgctcatggccttgggggccaaattgtcagcgatggtggctgttctgttccaggtgatgtggctaaagcttttggtggtggtgccgatttcgtgatgctaggtggcatgttggcaggccatgatgagtgtgaagggcgcgttgtcgaagagaatggcgagaagttcatgctgttttacgggatgagttctgaatctgcgatgaaacgccatgtcggtggtgttgcacaataccgtgcggcagaaggtaaaacggttaagttaccactgcgtggttcagtcgataataccgtgcgtgacatcatgggaggcctacgttctgcatgtacttatgtgggcgcttcacatttgaaagaattaacgaagcgtacgacgtttattcgcgtagcagagcaagaaaaccgcgtatttggcactgattgatacgggttattacggcatgataatttgccagtaatgtcgtcatcaggatacctgagcgctgagttgtagggtgccaacgcaattcaatatagggttgcgtggtagataagggcctaattttcgagactgtaaacaatattgtgtaattgcctgtttttgatatcttcactccaacaacggagacaggcaaattatggacgaaaagaaacttaaagcacttgcggctgaactggctaaaggtcttaaaaccgaagccgaccttaatgcattttctcgtatgctgacaaagcttaccgtcgaaacagcgttaaatgcagagcttaccgaacacctcgggcacgagaaaaatacccctaaatcaggctcgaatacccgcaacggctattcgtccaaaacactgctatgcgacgacggcgaaatcgagctgaatacgccacgcgaccgcgaaaacacctttgaaccgcagctgataaagaaaaatcagacgcgtatcacacagatggacagccagattttgtccctgtacgccaaaggcatgaccacccgcgaaatcgtcgccaccttcaaagagatgtatgacgccgatgtgtctcccacgctgatatctaaagtcaccgatgccgtaaaagagcaggttgctgaatggcaaaaccgccaactggatgctctgtatcccattgtttatatggactgcattgtcgtaaaagtccgccagaacggtagcgtgataaacaaagcagtgttcctagcgctgggcatcaacactgaaggtcagaaagagctgctgggcatgtggctggcagaaaatgaaggtgcgaagttctggctaagtgtgctgacagagctgaaaaatcgcggtcttcaggacattctgattgcctgcgtggatggcctgaaggggttcccggatgcgataaacagtgtttatccgcagactcacatccagctgtgcatcatccatatggtacgcaacagcctgaaatatgtgtcatggaaggactataaagccgtcaccagcggtttgaaaatggtgtatcaggctccgacagaagaggcggcgctgatggcgctggataagtttgcggaggcctgggacgacaaatacccgcaaattagcaaaagttggcgtacgcactgggaaaatctcaatacattcttcggctatccgcccgatatccgcaaggctatctacaccacgaatgccatcgaatcggtgaacagcgtgatccgtgcagccattaaaaagcgcaaagtgttcccgacagacgactcagtgcggaaggttgtttatttggcgatcaaggatgcatcaaaaaaatggagtatgccgatccagaactggcggttagcgatgagccgttttattatcgagttcggtgaccgcctgagcgatcacctttaatacggtggcagttacacagaattatggacaggctctaattttcgcccttatctactgggccaagctaacgctttcaggttgttatttctgaccgttgtatgtggctgtattcacgtatggtttttatatttacctgctcaactgctcaactgctcaactgctcaactgctcaactgctcaactgctcaactgctcaactgctcaactgctcaactgctcaactgctcaactgctcaactgctcaactgctcaactgctcaactgctcaactgctcagcgtcccaacgccccgttagtccttcacttactctctccgcaatgcctttctggtcttgcacctgatcgtgccattacatcccgccatggcatgccatgcactccacgatgcccagttcaccatccactaggtccataatgaggttacccgataacatcacctaactggaatatgggtaaatacatggcgatcaccagtacgccgacaatactgccaataatcagcataagaagtggctctagcatttgagtgacgttatctgccaaattctgagtttgttgctgatgccaacaggctaacttttccagcaacacatccagtgagcctgattcttcaccaaccctaatgagctgctgacaaatggcaggaaataaagggtgctgattaagagtggtatacagcggtataccttggctaatttgtttttgaatacaccttaaggcttgctgataattgtaattgtgaatggatcgagccgctgcatctaacccggctgacaggggtagcccggcttgttgtgtgatagctaacgtttgaaaaatttggctgaggcagctaccacggattaatgttgagaccaagggaatgcttaatagaatggtctgttcccattgctgccaacgagatttttttcgtaatgtatagaaatacccaatacacactattgctattatcagcgccagataggggccataaaaagtgagaaaagttgatagccacagtaagcttgcagttagccccggcaggggggtatcaaacgattgatatatttgtgcaaattcgggtaacaccatgactaacataatgacactgactaccaatgcgacgatgcagaccacaacggggtatttcagcgcttttatgacttttttgtgtaaattttgctgccgttcctgatggtgtactaattgagtacaacattgctcaagattacccgtaagctccccgacggcaaccactggaggatacagtcgggggaatacgtgtggatactgttccatcacttccgagagtgactggccttgtgcaacttgctgacttatctcatctaataggcaacgccatgctgagtcatctgcctcttttgccaataactgtaaactgttgaccaacggtaaacccgcttgcaataaagtcgctaattggcgggtcattgccaccaaccgttccccttgccagtagcgtgcagataaccgccttccccctttcacgcctaggggctgtaagccatgttggatgatatgttcatagacactgtttctctcagttgccagtagcatgcccgtctgtagctcccctgttttgttgagagctgtccaattgaataaacgatggcggctcaagaggtgacctctgtttctgctacgaagcccacaacacgattaatttcactaagggtagtgatgcctttttcgattaaagctaaacctgagcagagtaaggctgtttgttcttgcttctgggcaatttgtaccagttttacagggctggcattattgagtatggcttgctgaatctgcggcgttacactcagcatttcataaatacccgttcggccataataacccgtacaacaatgctcacaacctacagctagatagtgttggatcggaccagaccttatgtgagctggtggaataaaggggtgagatgcagcctggcggcaatgtaaacataggcggcgcaccaagcgttgagcaatgacgagttttagacttgaggcgattaaatggcgttctattcccatttgtgccatgcgtatcagcgtttctgctgttgagttagtgtgcagcgtcgataggaccaaatgcccggtctgggccgcgttaactgcgatactggcggtttcattatcacgaatttcaccaaccataatgacatcagggtcctgacgtaggatggctcgtagtattcgagagaaatccagaccgatcttgctgtttacctgggtttggttaatgccattgacggggatctcaataggatcttcgacgctacagatgtttctttgtgtctgattcagccgcgctaaactgcaatataacgtaatggttttgccactaccggtagggccggtgaccagaatcagcccttgtggtgctgataatgcctgtgttaattgtttcagtgccgcatccgtcatccccagcttttctaacgtggtttgctgttgtatttgaagaatacgcaataccactttttcaccatattgcgtagggagagtcgctatccgcattgaatagtgtgaatcaccaaagggtaaggttagttgaccatcttgtggtaatcgccgttcagcaatatttaatttcgccatgaccttcaggcaactgctaatccgagctgcccattcggcctcgggtggggtgaattcatgcaacacaccatcaattcttaaacgaacacgatagtggtgttgataaggctcaaaatggatatctgaagcgcgtttttgaatggctagacttagcgtctgggttatgaattgaatgacgggtgtgtcactctcattatcaaacacagtatcatctattgtctgttgctgctgattgtgcggttttactcgcgacggatcacctcccttttgggataacaacgcgctatttagcccgttgttaatactactgtttaggttatttttcgtcgggctccccaaatacaatgattgttcaatcttggcttcgggccaatattccactctgacttgacggccacatgtgaaacgcaacgcggtcaataacgcttcatcaacggtctgggctgaagctatcgaaaggcttttaccatcaagagtgagtgccactgcccgataacgccgacagagaaggtgtaattcatcactaattgtttcaaatgaggacactgtaaattcagccatttgatggggccttatcattgaaacggaataccgctttacaactatcagtcatggcactatctgttgccgtacatgttctggcccagactaaatttccgttgctgtttcgggttggtgatatcgccaatgtcaggccagtaagcgtatgctggccacttaatgtaataacacctttggcaatatttattgcattgatataacgcgatacttgccctgcggggatcccattactgccagcgttgcagctatcaaggttggattgctcaagagcacaaagttctaccgccatcttgtaggggacgatggcctgtagcatgtcggtgagtgctgctttttggatataacgttgatatgagggaatgccaataccactgaggactgcaatgatagcaaccgcaaccatcaattcaattaatgtaaaacctttctgtaatgttaaaccctgatgtttagccattttacccctccatgtgtttaagaaactggaggcagggtgccgttttttaattcataccaacaggggctttgtgccgaattgcggggcgtattgacggatatttaggttattgcaataacgtaacagataacttcggcggcactcgcaaaacaggatattgacctgataataatggctatccgccgaagatagtttggtagagttactggaaacgcattgagaggtctaacgctgttatgtgcttggtaagcgcccctactgagatgaagtcaatgccggtttcagcgtaactgcgtaacgtttctaaagtgacattacccgagacctccaattgtgcactgccttgagtcttggcatggtcatcgcgcatttttacggcatcacgcatcattggaatggtgaaattatctaacataacgatatctgcacctgcttctagtgcttgctgtaattcatcaagggattcgacttcaacctcgatagggacatcggcatgtatccaaaaggctttggcaacggcttctttaatcgaaccggctgcaataatatgattctctttgattaggaaggcgtcagataaaccgagccgatggttattaccaccaccacagaggacggcatattttaatgcagtacgcaggcctggtagtgtcttgcgagtatcgagtagttgtgtttttagccccgcgagttgtacaacatagcggctgacctcggtggcaaccccagatagcgtttgcaggaagttaagtgcggtgcgctcacctgtcagcaaaatgcgagcaggtccggtcaaatggcaaagtgtttgattggctgtcagtttatcgccatctgtaaccagccactgaattgagatttgcgcacccagttgaatgaagacttcattcaaccagcgttgcccacaaaagataccgtcctcacgggtaataattgtggcggtagcttgtttatctgcggggagtaattgtgcggtgagatcacggtctgcattgacctctccgcctaggtcttcactcagtgcctgagcaacagtcgcaggtatatcactttgaattcgttccaatagctcggcgcggcggctgttggaattgtagcagcggggcggcatataaactccgaaatggcgaatagacaatcgtctaaacatgctaccctgttgcaggctgaagtgccatcaaagagccgttcaaagtgaacgatcagggtgattggagtaaataatgctgctggaaaacggctggattgtcggggttaaacaggtgctgtccccccattttgatctgaggccagagggtgaaatgccctctctgctggtgattcatagtatcagtctaccgcccagtgagtttggtggcccctatatcgatcagctcttcaccgggacactcaatgccgatgagcatccctattttgctagtattgtacatttacgcgtctcggcccattgcttgattcgccgtgatggtgaaatcattcagtatgttccgttcgataaacgggcttggcatgcaggtgtttccgtatttgctgggcgtgagcgatgtaacgatttttctattgggatcgagctggaagggacagatgtgttaccgtttactcccgtgcaatatcaacgactgactgagatcagtgcggttttatttgcccactatccaataacggtagagcgggtggctggtcacagtgagatcgcaccagggcgtaaaacagacccagggctggcctttgattggtttttttatcaacaaaatttagctaagttgcttgtatgagcatgttgccggtggcattacactagccagtgtaattgtatgctcgatgtaaccatatgatctgtttaattatattctctgtgtaactacatgctctagacaaccagttaatctctgtaactcagtaaagttagtgcagtcttattatcaggccggtatttatctctagggtggagatccgtcccgaatgctgtctggttctgtcattcatgaatgccatgggtatatgccctgtctcaggataggttcaatcaaagggagaataagagctaatgacattgtttacgctgttactggtgctggcatgggagcgcttgtttaaactgggcgaacattggcagttagatcaccgccttgaagttgtatttgcccgattgcagcgattttccttgatacaaaccattttgttaactgtcctatggatggtgctggtttgggggattttgcaattagtgcaaaatattttgtttggcttcccactattattgctttggatcctgatttgcctaatgtgtatcggtgcgggggggattcgtaggcactaccgagcgtatttgaaagctgctcgccaaggcgatattcatgctacagataaaatggcagaggaactcgcgctaattcatggtttgcccatagaaagtggtgagaaggaccgtctgcaatctttgcaaaatgccttactgtggattaactttcgctactatttagcccctattttctggcttattgtatgtggcagctatggccctgtagcgttggctggctatgccatgctacgaggatatcaaacgtggttagcacgccatcacacgcctttagagcgtgctcaaacgggtattgacggtatcttgcattggctggattgggttcctgtgcggttagtgggcgttgcctatgctttgttagggcatggtgaaagggctctacccgcttggctggcttcattaggggatttccactctcagcaatatcaggtgctgacgcggcttgctcagtattctttggctcgagaaccgcatttagatccggtgcagacaccccgcgcagcggtgtctttagcccgaaaagttacattgacgatcattgtcgtcgtcgcattactgacgatttacggcgcactggtttaatacactaatggattccgatgcttggggcttattgtgccccaacattggttaccctaagaattagttgcccgaataattggtcgccgcaataattaggaatatcaacgatccattctctccgccgatagcattttgtcatgagtgttggcctcagactaatgacaaaccccgatgactcgaactgaaacggtgaggataggcagaggagtaaagcgttcgcgccatatccatatatagtgcggctctagcttacatggatgttatttttctgtagggaaggcggcggctttatttgctgcctgttctcttcgccatcggtactttgtcaatagcctaggccagcactaagtgctggcctagatagggttaactagctgatttataaggaaatgggttgttctttacttggttgctttcctgctgctagcgctcagttgctgattctgacgttggctctgattcttcagaatataaccaatcgctaggacgactacccagacaggaataagtatcactgaaatccggatgctgggtgtcagaaacatgatcactaagatgccggtcaggaacaacaaacacaaacagttaccgaacggataccaaaatgctttgaattttggtattacgccctggcggtttttcgccgcacggaatttcaggtgtgccaggctaatcatcgcccagttgatcaccaacgcggataccactaatgccatcagtaattcaaaggcacggccaggtaacaggtagttaatcagtacacaaaacgcggtagcaaacgcagaaacagcaatcgcaatgactggaacacctcggccatccactttcaacaggattttcgggccattaccttgtttagctaaaccaaacaacatgcggctgttacagtatacgcaactgttgtagaccgagagtgccgccgtcagtacgacaatattcaagacagtggcgactgaattactgtccagcgcatcgaaaatcaatacgaatgggctgccgccttcgaccacttttccccatgggtagagtgataacaagattgccagagaaccaatataaaacagaagaatacggtagataacctgattggttgccttcggaatgcttttggccgggtcttctgcttctgctgcggtgatacccactaattcaaggccaccgaaagagaacataattaccgccattgccatcaccagacccatgatgccattcgggaagaaaccgccttgggcccataagttggttaccgtggcttctgggccaccccggccactgatgagcaggtaaccgccaaataaaatcatcgcaataatcgcgatcactttaatgatggcaaaccaaaattccatctcaccatagacttttacgttagccaggttgatggcgttgatggccaagaagaagacggcggcggagacccaagtagggatttctggccaccaatattgcacatagatccccactgcggtcagttcggccatcgccaccaacacatacagcacccagtagttccagccagaagcaaagccggcaaagtgtccccaatatttatacgcaaagtggctaaaggaaccggctacaggttcttcaaccaccatttcgcctagctggcgcattatcagaaacgcaataaaacccccaattgcgtaccccagtaaaaccgaaggcccagccattttgatggtctgtgctatgccgaggaatagtccggtaccaattgcaccacctagggcaataagctgaatatggcggtttttaagcccccgttttagctcagcaccctcttgttgatcactcatcaattacatcctttgtcgttgtgactactcgcgggcttaatcttagttttttgctatacccttcatcattggacgttacagagacgctagcgatattcattcgaactgcttaccggtattcgaaccatttaccggcattcgaatcacttaccgaaataaacttctcgggatccatttgcttgcggcttgcttataacgccagtgattacgggtattaatgtaatcctttaattacactggttgtattgctttctttacgattaacctttttcgtatttcatttacaggctaccgtttgagagagaatagtggtaagcaaaaaactttgcatctgctttttcttttggttgtctaatttttgagcaaaatggcaataaagatattgagatgtgatcaaactgatgttttggaaaaaatcttatagtgaggaaaaagagtcatgtgtgctttctaggctataaatgagtcgtgagccattttaatttttcttatattggttcactgatgaaagaaaatacggatatgaagtttctttagttaagtgtgaatttaaattcaaaaaatatgaatttaaatttaattattaaatgactataacgcttcagcttgcctaatcatccgttttatcaaggttaatattctgtagagtcaggtaatggtattaccaccggtacgttatcactttgctcttctttattcataaagttgttaaaatgtgctgggtttcatgatttcggtcaaggtccgtatggacagctagtgaatactttgttactttatcgtcacgtttttgaaattggtattaccaattgactccgcgccactcgcagagacgattcactcaatacggcttacaccaaatatggcctacaacaaaatacgtcaacccaaactatcagatgtaatcgagcagcagctcgaatacttgatcttggaagggacgctgcgtccgggtgaaaagttactgcctgaacgtgagttggcgaagcaatttgatgtttcccgaccttctttgagagaagctattcagcgattagaggctaaaggcttgctgttgcgccgtcagggagggggtaccttcgttcagaccaatctgtggcaaagctttagcgatccgttagctgaactgctggcagaccatccagaatcacaattcgacctgcttgaaacccgtcatgcccttgaaggtattgccgcctattacgctgcattacgtggcactgatgaagatctgcaacgtatccgtgagtgccatactgtcatccagcaagcgcaggataacggtgatttggatgctgaagccgatgcggtgatgcagtatcaagtggcggtcacagaggctgcacataatgtggtcttgctgcatttactccgttgcatggggccaatgctggaacaaaacgtcagacaaaactttgaattgctctacttgcgccgcgaaatgttggccactgtgagcagtcaccgagccaggattttcgaggcgattgtggcacgtgaaccagaaaaagcacgagaagcatcgcaccgtcacttggcgtttattgaggagattctgttggatcttagccgggagcacagtcgccgtgagcgatctttgcgtcggctccaacagcgcaaggagtagaaacgaatcattcgggttgcgcctctgcaagacctcaataactcgttttggattctcatttgagaattattagcggcaactaaactgatgggcctatctttctgttcttcaccagggcgtgtgctttacccttgtgttaaagcattagaagatggactccaaataaaccattagaaataaataaggaataccaccatgtcagaacgtttaaataatgacgtggatccgatcgaaacccgcgactggctacaggcgatcgaatcggtcatccgtgaagagggcgttgagcgtgctcagtatctgattgatcaggtcttgggcgaagcccgtaaaggtggcgtgagtgttgctgcaggttcggcaaatcgtgattacatcaacaccattccagtagaagatgaacccgcttaccccggcaatctggacctggagcgtcgtattcgttctgctatccgttggaatgcggtgatgacggtgttgcgtgcatctaagaaagatctggatttggggggccacatggcgtccttccagtcttccgctacgttctacgaggtttgcttcaaccacttcttccgtgcccgtaaccaaaaagacggcggcgatctggtttacttccagggccacatttctccaggtgtttacgcgcgcgccttcctggaaggccgtctgactgaagatcaaatgaataacttccgtcaggaagttcacggtaaaggtctgtcttcatacccgcatccaaaactgatgcctgaattctggcagttcccgacggtatccatggggctggggccaattagtgctatttatcaggccaagttcctgaaatacctctcgcaccgtggtctgaaagacacctcagcacagactgtttacgccttcttgggtgatggtgagatggatgagccggaatccaaaggtgcgatcaccatcgcaacccgtgaaaaattggataacctggtcttcgttattaactgtaacttgcagcgccttgatggcccggttacgggtaacggcaaaatcattaatgagctggaaggtatcttcagtggtgctggctggcaggttctgaaagtcatttggggtggtcgttgggatgaactgctgcgtaaagataccagcggcaaactgatccaattgatgaacgaaacgctggatggcgactaccagacgtttaaatctaaagatggcgcctatgtgcgtgaacacttctttggccgcttcccagaaacggctgcattagtgaaagacatgactgacgatgagatctggtctctgaaccggggtggtcatgatccgaagaaagtctttgctgcactgaaaaaagcgcaagaaactcaaggtaaaccaacggttatcctggcccataccattaaaggttacggcatgggtgaaacggctgaaggtaaaaatattgctcaccaggtgaagaaaatgaacatggatggggttcgccacttccgtgatcgtttcaatgtgccagttgccgatgctgaaatcgaaaaactgccatacatcaccttcgagaaagattccgaagagtataaatatctgcacgaacgccgtcaggcgctggaaggctatgtgccaacccgtatgcctaaattcaccgagaagctggaaatccctgccttgtcagatttcagctccttgttggaagagcagaataaagagatctctactactatcgccttcgtgcgcgcgctgaacgtgatgttgaagaacaaatcgatcaaagatcgtattgttcccatcatcgctgatgaagcccgtacttttggtatggaaggtctgttccgtcaaattggtatttacagcccgaatggtcagcagtacaccccacaagaccgtgaacaggttgcttactacaaagaagatgagaaaggccagatcctgcaagaagggattaacgaactgggtgctgcctcttcatggctggctgctgcgacttcatacagcaccaacgatctgccaatgatcccgttctatatttactactccatgttcggtttccaacgcatcggcgatctgtgctgggcggcgggtgatcaacaagcacgtggcttcttgatcgggggtacctcaggtcgtacaaccctgaacggcgaaggtctacaacatgaagatggtcatagccatattcagtcactgactatcccgaactgtatctcttacgatccggcctatgcttacgaagttgccgtcattatgcatgatggtctggagcgtatgtacggtgaagcgcaggaaaatgtttattactacctgactacgctgaacgaaaactatcacatgccagcgatgccacagggcgcagaagaaggtatccgtaaaggtatctacaaactggaaactgttgaaggtagcaaaggcaaagtgcagctgatgagctctggtgcaatcttgcgtcacgttcgcgaagcggctcagattctggctaaagattacggcgtaggttctgatgtgtacagtgtgacctccttcactgaactggcccgtgacggtcaggattgtgagcgttggaacatgctgcacccgacagaaacaccacgtgttccttatgtggctcaggtgatgaatgatgcccctgcggttgcgtctactgactacatgaagttgttcgctgaacaaattcgtaactttattcctgccagcgagttccgtgtactgggcactgacggtttcggccgttctgacagccgtgagaacctgcgtcaccacttcgaagttgattcttcttatgttgtggttgcggctctgggtgaattggcgaaacgcggtgacatcgacaccagtgtagttgctgaagcaattactaagtttggtatcgacgctgataaagttaacccgcgtctggcataagaggtagagaataatgtctatagaaattaatgtaccagacatcggtgcagatgaagtggaagtcaccgaaattatggtgaaagtgggcgataccgttgaagcggaacagtcgctaatcaccgttgaaggcgataaagcttccatggaagttccttcacctcaggcgggcgtggttaaagagatcaaaattgcggttggcgataaagtggctaccggttctctgatcatggtcttcgacgctacgggtgccgctgcggcaccggttaaagcagaagaaaaaccggcggcgcctgctcaggcagcggctccggcagcctctgcggcgaaaaatgttgaagtgccagatatcggtgatgacgaagttgaagtgactgaagtgatggtgaaagtgggcgataaagttgacgccgaacaatcactgattacggttgaaggcgacaaagcgtcgatggaagtgcccgcaccgtttgctggtatcgtgaaagaaatcaaaatcagtaccggcgacaaagtgaaaaccggctctctgattatggtcttcgaagttgaaggtgcagcgccagcagcagaagcggctccggctcaacaagccgcacctgtcgcgccagcgccagccgccgcacctgccgccaaagcagaaagcaaaggcgagtttgccgagaatgacgcttacgtgcatgccacgccggttatccgtcgtctggcgcgtgagttcggtgtgaacctggcgaaggtgaaagggacaggccgtaagggccgtatcctgcgcgaagacattcaagcttacgtgaaagatgccgtgaaacgtgccgaagctgcaccagcagcggctggcggcggcctgccgggcatgttgccttggccaaaagttgatttcagtaaatttggtgaaatcgaagaagtcgaattgggccgtatccagaaaatttctggtgcgaacctgagccgtaactgggtcatgatcccacatgtgacgcaattcgatgaagcggatatcactgaagttgaagccttccgtaagcaacagaacatcgaagctgagaagaaaaaacaagacctgaaaatcaccccgctggtgttcctgatgaaggccgccgctaaagcactggaagaattcccacgctttaacagctccatttccgaagatggtcagaaactgacgctgaagaaatacatcaatatcggtgtggcggttgatacgcctaacggcttggtagttccagtattccgtgacgtcaacaaaaagggtattgtcgagttgtctcgtgagctatctgtcatctccaagaaagcacgtgatggcaagctgacagcatctgacatgcaaggcggctgtttcactatctccagtctgggcggtatcggcggtacggcatttacgccaatcgtcaatgcgccagaagtggctatcttgggtgtatcaaaatcatccatgaaacctgtctggaatggtaaagagtttgctccacgcctgatgttaccgctgtctctgtccttcgatcaccgtgtgattgatggtgccgcgggtgcacgcttcgccgcgtatatcgctaccattatggcggatattcgccgtctggtgatgtaatcgccaaggccggcttcgtgccggccttgttgtggttactgctcttgttattggtgatcttgttattactgatcaccaatagagaaaagacacttataaaccggctttgtcaggctgttacattagtcgacaaggttgttgagacactggtcacgcgatgcggcttttcagtttattaacaattctgtaaactgcccgcgagtcagttcccggtataagagcgtcccggtggatgagggcgttatgaaattgattcgcctaaaaaatgatgtcagacccgccggacaaacaattaagaggtcatgatgagtactgaaattaaaactcaggtcgtggtacttggggcaggtccagcagggtactctgctgcttttcgttgtgcggatttagggttagaaaccattctggttgaacgttactccactctgggtggggtttgcctgaatgtgggttgtatcccttccaaggcactgttacacgttgccaaagtgatcgaagaagccaaagcgctggctgaacatggtatcgtttttggcgagcctaaaactgatattgataaagtccgtgtctggaaagataaagttatcaatcagttgaccggtggtttggcaggtatggctaaaggccgtaaagtcaaagtagtgactggttttggtaaatttaccggtgcgaacaccttagtggttgatggtgagaatggtccaacaaccattaacttcgataacgctattatcgcggcgggttctcgcccaattcaactgccattcattcctcatgaagactcacgtatttgggattcaactgacgcactggcattgagaacggttcctgagcgcttgttggtgatgggcggtggtatcattggtctggaaatggggaccgtttaccacgcactgggttctaagattgacgtggtcgaaatgcttgatcaggtgatccccgcagcagataaagacgtggtgaaagtctttaccaagcggatcagcaagcagttcaatctgatgctggaaaccaaagtgacagcggtagaagccaaagaagacggtatctatgtcacgatggaaggcaaaaaagcgccagcagagccacaacgctatgatgcggtgttggttgcgattggccgcgtgcctaacggtaagttgctggatgcgggtcaggcgggtgttgaagttgatgatcgtggctttatccacgttgataagcaactgcgcaccaatgtgccacacatttttgctatcggtgacatcgtgggtcagccaatgctggcgcataaaggtgtccacgaaggccatgttgccgctgaagttatcgcaggcatgaagcactatttcgatccgaaagttattccatcgattgcgtacactgaaccagaagtcgcatgggttggtttgaccgaaaaagaagcaaaagagaaaggcatcagctacgaaacctccaccttcccgtgggcggcatcgggccgtgctatcgcttctgattgcgcagatggtatgactaaactgattttcgacaaagaaactcaccgtatcattggtggtgcgattgtcggtactaacggtggcgaactgttaggtgaaatcggtctggccattgagatgggttgtgatgcagaagatatcgcattgaccattcatgctcacccaacattgcatgaatcagtgggcctggcggcggaaatctacgaaggtagcattactgacctgcctaacccgaaagcgaaaaagaaataattttttgttgatgctgcatttacagatgtgaatgtacagaggtaaatgtacagcaataaataaaagtgaaacggtccctacataggggccgtttttttttagcctatacgcggtagttaagtgtagcgactcagagagatggtatcctctcattggttatggttattatgagatgccggttttaccgataaaccttgccaacaacaggccaagtgagagcgattatcaatacctcaggtgattacactgcactcaacgattcagcaaaaatttaatgttgcttttatgtgaacgaattaacactgagtttaaatactggtatgctggcggggcgaaactggacgtcttaccctacattgactacatcagtgctgatggctggtagcaatatacctaatagattttaaggtgcaggaaggcagcaagcgagagaggcttaatgagcttataccagtaagtgatttgggtgattgaacgcagccaacgcacatgcagcttgaagtcacttgggtatagatagccgggtaaaataaatgacaataagagcgaggagaaagtcgtgctagaagaataccgtaagcacgtagccgagcgtgctgcagagggtatcgtccccaagccattagatgcgtcacaaatggcagcgctggttgaatcattaaaaaatccgcctgcgggcgaagaagaattcctattagacctgctgactaaccgtgttccacctggtgttgatgaagccgcttacgttaaagccggttttctggctgctatcgccaaaggcgaagcccactccccactgatcaccgcagagaaagcgattgagctgcttggcaccatgcaaggcggttataatatccacccgctaattgatgcattggataatgagcaactggcacctatcgcggcgaaagcgttatcccacacgttgctgatgttcgataacttctacgacgtagaagataaagccaaagctggcaatccgtatgcaaaacaaatcatacaatcttgggctgatgcggaatggtatctatcccgtccggcgttggcagaaaaactcaccgtaaccgtatttaaagtgacgggtgaaaccaacaccgatgatttatctcctgcccctgatgcgtggtcgcgcccggatattccattacatgcgttggcaatgctgaagaacgcccgtgaagggattcatccagatcaaccggggagcgttggcccgataaaacagatcgaagaactgaataaaaaaggttttccactggcttatgtcggcgatgttgtgggtaccggttcctcccgtaaatcggcgactaactccgtattatggtttatgggtgacgacattccttacgtgccgaataagcgcggtggtggtgtggttctgggcagtaaaattgccccaatcttctttaacaccatggaagatgccggtgcgctgccaatcgaagtggatgttgccaaactgaatatgggcgacgtgatcgatatcttcccgtatcagggcgaagttcgtcgccacgataccggtgaagtattagccacctttgaattgaaaactgatgtgctgttggatgaagtccgtgccggtggacgtattccgctgatcgttggtcgtggcttgaccaccaaagcccgcgagtcactgggcctgcctgtcagcgatgtgttccgtgtgccaaagccggtagccaaaagtaacaaaggtttctcactggcgcagaaaatggttggccgtgcttgtggcgtcgcgggtgtgcgccctggtgaatactgcgaacctaaaatgacgtcggtcggctcacaggatactaccgggccgatgactcgcgatgagctgaaagacttggcttgtctgggcttctctgccgatttagtgatgcagtcattctgtcatactgcagcgtatcctaagccagtagatgtgacgacccaccacacattacccgatttcatcatgaaccgtggcggcgtgtcgctacgtccgggcgatggcatcattcactcttggcttaaccgcatgctgttaccggacactgtcggtaccggcggtgactcccatacccgtttccctattgggatctccttcccggcgggttctggtttagtggcctttgcggcagcgaccggcgtcatgccattggatatgcctgaatctgtattggtacgctttaaaggtgaaatgcaaccggggatcaccttgcgtgatctggttcatgctatcccttactatgcgatccaagaaggcttgctgacggttgagaagaaaggtaagaaaaacatcttctcaggccggattctggaaattgaaggtctaccagagctgaaagtcgaacaagctttcgagttggcagatgcctctgctgaacgttctgcagctggttgtaccatcaagctggataaagcgccgattaccgaatacctgcaatccaacgttgttttgctgaagtggatgattgcagaaggctacggtgatcgtcgcacactagagcgccgtatcaatgggatggaaagctggctggcgaacccgagtctgctggaaggcgatgccgatgctgaatacgcagcggtgattgaaatcgatctggctgagatcacacagcctattttgtgtgcaccaaacgatccggatgatgctcgcttgttgtctgatgtggctaacagcaaaatcgacgaagtctttatcggttcctgtatgaccaacattggccacttccgtgccgccggtaagttactggatcagcataaaggccaactgcctacccgcctgtgggtggcaccaccgaccaagatggatgcagcacagctgacagaagagggctattacagcgtctttggtaagagcggtgctcgtattgaaatccccggctgttcactgtgcatgggtaaccaggcgcgggttgctgacggtgcgacggtggtatccacctcaacccgtaacttcccgaaccgtttagggaccggggcgaatgtgtatctggcatcggctgagttggcggcgatagcgtctctgcttgggcgcttaccaacgcctgatgagtatcagacttacatggctcaggttgataagaccgccgaggatacttatcgttatctgaactttgatcagttaagccaatatacggataaagctgacggtgtgatcttccaaaccgcggtgtaaggcgtagtcccctttgtcagtgacgttgggtatctattcgcatcagctaaaacggggggccattggcctcccgtttctattttaaaaacggtgctgtatttttgctattcggcaattatgttttagctatctgccattatttttttaactattagcattacgttttaacgatcacagcatgttttaacgatcgcattatgttgtaatgctcacgatacttgtaagcggtgtgagcttgcgccaagccaggttggcaataatgtttacactaatagaaagagcattaggaggacctgctatggattatgaattcttgcgtgatttaaccgggcaagtactcgttaaattctccatggggcatgaagtgatcggccattggctgaatgaagagatcaaaggtgatttggtaaaactggatcacattgaaacggcggctgacggtgtcagagggagcgagcgccagtggcaactcccaggccatgaatatacgttgtggctggatggtgaagaagtgatggtgcgtgccaatcaattagatctcgacggcgatgagatggaagaaggcatgaattattacgatgaagaaagcctctgtctatgcggtttagaggactttttgctggtgttgaaaggctatcgggcttttattacacaataatatctacccaaataacgtggtgttgcaggaagggtgttgcaggtaggcagtaagagagtggccccgatgggcttagataagtaagtgattcgggtaagcggacaccactaacaaccctacggcttcaagtacgaaggggatttcggctggctgaccagcatagcaacgaacctgctacaaccatggcaacgccaggccagaaagccgcagaaggcaaggtattgagccacacgctggcgatcaatattgataacaatggcgtgaaataggatagggccgcgaccagtgtggcgttgccttttttcattgcgctatcccagcattggtaggccagtgcggtattcgcgcccatgagtaacaattcaaatatggctcgtggggtaaagtgcaatttgcccggagtccacataaagaacatcaaccacaggcacagggcgcaggcgattaaaaacagtggcagcgcccctggcccttggctatataaccgtactaagttggagtagcccgcccaggtgaatgctgcaatcagcgccaggctgtacgccagcgggttgctgctgatatttacggcgagcgttttaacgtccagcccttcaccaccactgaccacccaaataacaccaaatagagcgagagccgcccccggccataaccaccaacgggcgcggagtttcagcaacggtaccgccaatagcagcgttaggctcggccataggtaattgattaagcctatctccagtgtttgctggcgatcattagccataccgattgccagagcgaaggccaccatatacaccacaaacagtaaaccgcagccatacagataagcgggatgctgcccacgtactctaggcttacctgccactagccataccagaatcccactgacactgtagatagccgctccggcaccgaatggccccagtgcttcggccagcccacgtgttaaggcgacactcatgctccacagtaaaatcgcaataatgccatacagggttgggaggcggttcattagggggcatcttccttgtgcaatgctaaaggggggaagaatatcatcttcttatacttgtcatacttcaagttgcaggggttatgtattcaatacgttgataacccatcaaaagcaactctcgcgttcaataaaagtgccgatgatcctatcgtgcatttctggtgattttgaatacccaagcgtaccacagccagtgctggtatttgttgttgccagcaaacgaccacatctcaacatattgaatatttgacctgatgtgttagggacgctggtgcagaatgtcaaacaggactggctgaattgtatcgagagaatggagtagaccaaccctgaacgggtaattacgacgagccgtttttaggtgatcgcctgaacgatcacctttaattccgtatcagttatacagaattatttagagcctaggctgtaatgcatcacacttccggcacattgcggccatagtagatttcctgcatttctttgtataacaggcaggtaatctgttccttttcttctgcgcttagctcttccggcttggcgttaaacagataatgctttaaatcgaaatctttcagcatcatcttggtatggaagatattttcctgataaacattcacatccatcatgtgataaagcgacttcatgtcatcggacataaaattctgaatggaattgattttgtgatcgataaaatgttttaccccattgatatctcgggtgaaaccccgtacccggtaatccatggtcacgatatcggattcgagctgatggatcaggtaattcagggccttcagcggagaaatcaccccacaggtagagacctcgatatcggcacggaaagtacataaccccgcttcagggtggctttctggataagtatgcacacagatatggctcttatccaggtgggccaccacggcgcttggcaatggaccgggatgttcagaggtatcaacatcgcgcggatcaacgggctcttcactgaccaaaatggtgacgctggcaccttgtggatcgtaatcctgacgagcaatatttaaaatattggcaccgatgatcgagcaggtttcgctcaagatctcggtcaagcgattggcattgtactgttcgtcaatgtaggcgatatagccatcgcggtcgtctgcggtcttggcataacaaatatcgtaaatacaaaaactcaggcttttggtcaggttgttgaagccgtgcagtttaagcttggacaatttagttcacctccttacaaatgaatactcaacatttatcccttttttactcggcactactgcgttgctagcggctcttattcacttgaatcgacgccaatgactttgggtatcgtcgttaaggcatctagcaaatactgtggtaaagcaaagctgccgacatgaatcgctgggttatagtagcggcaggccaagccagcttgggcaaagcggttttgcaaggtggcgagatccaactggcgcagagccgggttctgtgtcgcccaggcaaaggtcataataccgccgtaatacgttggaattgcggcctgataaaaactaacgtcactgaaatagtggctaagtttgttatggctattgacggcttcatcctgttgtaggaaacagacgccgttttgtgcaacgaagatccccccctcattcaggctacgggcgcatccctcataaaatacagaggtaaacaggctttcgccaggaccgataggatcggtacagtcagaaatgatgacatcgaacttttcagtggtctgattaacgaaattcacaccatcgtcgatgactagcttgaaacgaggatcgtcatacgcccccgcgctatgattaggcaaatactggcggcaaaattctacgaccccggcgtcaatttccaccatggtaatctgctcaatattcttgtggcggctgacttctcgcagcattgcgccatcgccaccgccgatgatcagcactttttttgcttgcccgtgggccagcaaaggaacgtgtgtcatcatttcgtggtagataaactcatcacgctctgtcgtttgcaccacaccatctaatgccattacgcggcccaactctgggttttcaaaaatcaccaggtcctgatgctcggttttttcgcggtacaatacattctcaacagaaaagtactggccgaagttggcatgtaatgtttcataccatagttctttctgtgacatgttcggggcttctccttcgcagtaacagccatgaaaaatggggggcaatatcatagccaattctgcctgaggttgcacggtcaaatttcaggcaaaaggcgttaaaggtgggatggtcaattagcgtaggctaataaactcaaagagtcacgggctagagacttacattttacaggggtaggaagggcgataccacgtagatcgcgatagctgtcttcacctaatgccttcatattaaagctatcgtaattgtggagatcccaacgattttgctgcgcaaagtagacaatggctcgcttaatttcgttgttagggagctcctgataaccacaatcattttttagataaacgaaaacagcggtcagatcggcaagatcttcagcttcagattcacttaatgcaaagctggcagatgagaatccgcacagagtaagcagcagcatgactaacgttgttcttttcatagcaaaaataggtttatttattgttcacagacgttaccacacagtgatgtcacaaactaaattttattgtattgagcgaaagcatagtgtgagtgattgcttcttgaccttcccctaagaggagggtttaagctcgtataccgtgttttttatgcgtcaacggaatgcgtcaacggacgacttgtgtgtcaatggacgacgtgtataccaacagacggtttttatatccatatatccatgtgctatgcaggtatttacctacggtcagcatttacccatgatcagcatttacttatcatcaagaagggagacgaccatgcatcgccgtgattttcttaagttaacggccgctcttggagctgccacatcactgcctttatggagccgagcggcattggccgcagatttttccccgttacccattccccctctgctccaaccggatgccaacggtaaaattaatctgaatattcagacggggagtgtggtctggttaccttccactgcgacgcaaacctggggctataacggtaatttattgggtccagcgattcgtttgcagcggggtaaagcggtaaccattgatatcactaatgctttaccggaagcgaccacagtacattggcacggtttggagatccccggcgaggttgatggtggcccacaggcgttgattcagccaggggcaaagcgtcaggttaccttcgcggtggagcaacccgccgcaacgtgttggttccatccgcacactcacagtaaaactggccaccaagtggcgatggggttaggcgggttagtcctgattgatgacagcgacagtgagaagctgccgttgccaaaacagtggggcgtggacgatattccggtaattttgcaggataaattactcgataaacatgggcaggttaactatcagcttgatgtgatgaccgccgcagtcggctggtttggtgaccggatgctgactaacggcgttccttatccgcaacaaattacgccacgtggctgggtgcgattacggctacttaatggctgtaatgcccgttcgctgaatctggcgcttagcgatggccggccaatgtatgtgattgccagcgacggcgggttattagccgaacccgttgtggtgcgtgagttaccgatattgatgggcgaacgtttcgaagtgctggtggatacccgcgatggtcagtctctcgatttggtcaccctgcccgttacgcagatgggcatgaccttggccccgtttgatcagccgctgcccgtgctacggatccaaccctcactggcgatcggcagtcaggttttgcccgagtctctcgtggtgatcccggaattagccgatgtcactggtgtgcaggagcgctggttccaactgatgatggatccaaagctcgatatgctggggatgcaggccttagtggcgcgttatggcatgaaagccatggccggtatgaagatgaatcatggtgacatgggggcgatggaccatggcaatagaccagatatgagccagggcaaaatgaaaggcatggatcatggcacaatgaacggtgcgccagcctttaatttcagtcacgcgaataggattaacggtaaagctttctcgatgaccgaacccgcgtttgacgcgaagcagggcaaatatgagaaatggaccatttcaggtgaaggcgacatgatgctacatccattccatgttcacggcacacagttccgtattttaacggagaacggcaaaccgccagcagagcatcgccggggatggaaagacatagtacgtgttgaaggcgcacgcagtgaaatattggtgcgctttaattatctcgcccctaccagtacgccttatatggctcactgccacttattggaacatgaagatactggcatgatgctgggctttaccgtcagcgcctgagccactccccggtcggttgaccggggtgttttttataaaaccgccatcaatgcatcccactgcgcatttttgttatactttgtctcccctaagctggcagagccactggatgcctcctgatgtgtgttaagctatgggcatcaatctgtatcattgaggccatcgatatcggtttcccattgatataaaagttcattcatttaaataggtatgttggctgtgaagcacactgtagaagtcatgatttccgaacaggaagtaaaaacccgtatcgccgaattaggccgccaaatctctgaacattaccgcgacagtggcagtgatatggtgctggtggggttactccgtggctcatttatgtttatggctgatttatgccgtaccattgatgtttctcatgaagtcgattttatgacggcctccagctacggcaacggtatgagcaccacccgcgatgtgaagatcctgaaagatctggatgaagatatccgtggtaaagatgtgctgattgttgaagatattattgattccggtaatacgctgagcaaagtacgtgaaattctgcaattgcgtggcccaaaatcactggctatctgtacgctgttggataaacctgagcgccgtgaagtgcacgttccggttgagtgggtgggtttcaccattcccgatgagtttgttgtaggctacgggatcgattatgcgcagcggtataggcatcttccgtatgtaggtaaggttgtcactttagacgagtgatcgggctactgcgcgtcgccattttgagtttacgcagtgctcagaatcctcacgtactgtatgtacgctccggttcttgtgcgctgggtgcactcaaacttgtctagctcgctacgcccgtggctttgggaatgatattggctactgcgcgtcgccatgttgagtttacgcagtgctcagaatcctcacttactgtatgtactgcacgtactgcatgtacgctctggttcttgcgcgctgggacgcttaatttagcggaagggttttgtgggagagggcgcgttttaacgtaccctcccagagcgacttaatggtcttctttattgttttgtaataactcagccattgctttgcgatacaccatttccaggctaccaaggctggtggctgagacttctagatcacgcagcaggccattttcaataccatatacccagccgtggatcatggctttttgcccgcgcttccaggctgaacgcacaatggttgaatgaccaaggttatacacttgctctactacgtttatctgacacaacacattactgcgttcttcttgtggcagttcacccaacaatgaactgtgtttataccaaaggtcccgaatgtgcagtaaccagttatcgataagccccatctcttcgcctttgatggccgcttcaacaccaccacagccaaggtggccacagataataatgtgttctacctgaagaacatcaatagcgtattggacgaccgataggcagttaagatcggtatggataaccagattggcaacgttacggtgaacaaataactcgcctgatttcaatccagttaactgctctgcgggaacgcgactgtctgaacaaccaatccataagaagcgcggtttctgagattgtgccaagtgctcaaaaaaaccgggatcatctttacaaatggtgtttgaccaagttcgattgttcgcgatgagcttttctatttctttcatcaatgtaaatagcctgtagtgttcgggttgcgatagaataatatacggcaaggattccgattttgaaatcggaacagtagtttcggtaataacgcgatattgtctgcgtaatatcttctcggtgcctgtttgattttttatgttacccgtaacgtccctcatgtggggagggttaaatacgtcatgggtacgcaggaccaccaagagccccattgaataaggttcctttttacttatgacatatgcactggaaataacgcagttgaccaaaacctatatgggtggcgttcaggcactgcgtggtatcgatctgcacgtagaggcaggcgacttttatgctctgctcgggccgaatggggcggggaaatccactaccatcggtattattagttccttagtgaacaaaacatccggcaaggttcaggtttttggttacgatatcgataacgatattgtgaatgctaaacgtcagctcgggttagtgcctcaggaatttaatttcaacccgtttgagacggtgttgcagatagtgattacccaggccgggtactacggcgtgacccggcgagacgcgttagcgcgggctgagaaatatctcagtcagttagatttatggagcaaacgtgatgagcgtgcgatccgtttatcgggtggcatgaaacgccgtttgatgattgcacgggcgctgatgcatgaacctaaattactgattttagatgaacctacggcgggtgtagatattgaattgcgtcgctccatgtgggggttcttgaaagagctgaatgcgcagggcacgacgattattctgacgactcactatctggaagaagcggaaatgctgtgccgcaacattggcattatccagaatggggaattggtggaaaataccaccatgaaacagctactgagtaagctggaatcagaaacctttatttttgatcttggggcgaaaagcccactgcctaaattggaaggttatggataccgtctgacggatacctcgacgttggaagtggatgttaagcgtgaacagggcctgaatggtttattcagccaactaaacgtacagggggttcaggtacaaagtatgcgtaacaaggccaaccgtctggaagagctgtttgtcaccttggttaatggccacgagggagagaaagcatgacccgcctgtattggatagccttgcagagtatttggatcaaagagattacgcggtttgcacgtatttggattcaaaccttggtgccacctgtgattacgatgtctctctattttgttattttcggcaacctaattggtgcccggattggcgatatggggggctttgattacatgcagtttatcgtccctggcttgattatgatggcggtgatcactaacgcctattctaacgtggcggcatcgttctacggggcgaagtttcagcgcagtatcgaagagttgctggtagcccctgtgcctacgcatattgttattatcggttatgtcggtggtggggtggcgcgcggcatttgtgtcggcattctggtgacgattatctcgttattcttcgtgccactgcatgtccattcgtggtcaatgattgccttgacgctgatactaacggccattctattctccctgggaggattgttgaatgcggtctttgccaagacatttgatgacatcagtttggtgccgacttttgtgctgacgccattgacctatctgggcggggtattttattcgttatcattattgccacctttctggcaggcagtctcgaagcttaaccctatcgtctatatgatcagcggcttccgttatgggttcctcggtattactgatgtctcactggcctacaccattggcgttttagtggtgtttatcgcggtattctatgcgtgggcgtggtatttgattgagcgtggaaccgggttacggacctaatatattccctttgtccttggcgctacagcggcgctcgtttgctgacttgctgtaacgccaagagctttgcaatgtgggtatataaataaatcgtgctgttacctgataacccctttttcaaccccaagtctctcgtgatatgctggcgcacactatttccctttttccattcagcgccgactgcgcataagtagaacaaacatgtggcataaaaacagaatagctattgggatgctactcagcattgtcatgtgggtaataatgataccgacaacccaggctgacctcttgccaaatgtggaggtcacaccaccaaaatatatgatgaccgaacgcgatagcgaagtttattcgttggttggtgaacatgttattcccgtcggagaaatcaaagaaggccagttgattcaggtgacgccagttattgctgaatactatgagtttaagtttggcaacggtaccggttttattgataaagatgatttacgtgagattaataaagcacaaaaaaacaacgacatgttgggcgatttaaataagcccctaccgaatcaaaatatactgacgatgcgtgaggctaaggtttatttggctgcggatgtgcgcagtgaacaatttgctgttctggccgagaacttacgttatcccattgttggaaaactgaaagatcgtttaagcaatacttggtatcaggtcaatattggtgatcgcttggggtatgtcagcagcgcagacgctgaaatagacaacggtattccgatcctgacttaccatcacatgttgaagaacgaagaaaataaacgcttcctgaacacatcaaccaccacatctgatgtggcgttcagtaatcaaatggcttacctcaaacaggcgggctatgacaccatttctctgtatcagctcgaaggctatcttaataacaagattaatctgcctgcgaaagttgtggtgctgacatttgatgatggtttgaagtcagtgagtcgctatgcttatcctattctgaaagagaatggtttccgcgccacggcgtttattatctcttcgcgtattaaacggcatccacaaaaatggaatccagattcattacagtttatgagtattgctgaactgaaaggaattcaagatgtgtttgatatacagtctcatacgcattttttacaccgcaccgataatagacaccatcctatattattgagtcgctcttatcacaatatcatttttgattttgaacgctcacgtcgggcattagcgcagttcaatccgcatgtgatttttctgtcatatcccttcgggggttttaatcaaacagcggtcaatgcggcgaagaatgccggttttcatttggcggtgaccacgatgcaaggcaaggtcaagccaggcgataatccatataccctgaaacggctctatattctccgtactgactcaataccgaccatggcggagcgcatagccaatcaacccggctcggttgcggtaaaaccggcacccgcagtgattgaaatggattaacgatgttatggcataagacatttatggcataaaaagaaaggatgttttatttaagcgcccgaggttaatcgcatcattatggctatctagccagtgatccaacagccggtgattcgggggagcgaacattgctaacccccgtagcttcaggtactgagggggattaagcgacctgaaccggcactgccttagctttgcgttgtagctgattttcaccttcaaaataagccactttagggtggtgcaaacgggcggcagcatctgacatctgtacataagaacagataatgagcttatcaccgacacaagcgcagcgtgctgcggcaccattcacggagataatccgcgaaccacgctcagcagcaatcgcataggttgaaaaacgctgaccgttatcaacgttataaatatcaatagcttcgtattccagaataccggcggcttccagaaaatcctgatcgatggcgcaggagccttcatagtgcaaatccgcttgagtgactttgacccggtgcagtttgccttgcaacatagtgcgtatcataactcttacctttgaccctgattaaatctcttaccagaccctataatctactgattcagggagcggctcaatcataaaaatagacccagatagatttcgcgctaagcgtcctgcggcctaagactttctgcaaaaaatgcccactcagttttgccgattttataccacttgtctatgattgatgccctatctgtaaattttccttgctgcctcttcatttcattacgtccacttccacggtatccgcgtctctcactcaccaaaatcgttgctcatcggcggtcacgggttccgagcgaacccgttatgggggaatgccgttgatagtgacttttgccttggcgttcctggttgattttgggccaactcacggcttgaggggaatgagcaaccgcctgatcggtaaaatatcagtggcgtaaatcaaccagttggttatcaatcagacgagctttacccaaccaggcggccatcaaaatcaccgcttgctggctatcgacagtcagtggctgtaaggtctcggcatcgcggataaacaattcatcgggtgtaaagcctgcacggagtagttgcgctgcagcgtcttccaacagtgcgtcaatctgccgttcgcctaaggccattttctctgccagcgcccacatgatcttactgagctgtggcgcaatctgacgttcttcttccgtcagatagccgttacgggaactcagcgccaaaccatctttcgcgcgcaccgttggtaccccaacaatgttgatgtcataacccatatccgccaccattttgcggatcaaggcgagctgctggtaatctttttcgccgaaacaggcgacatctggctggatcagattaaacagcttgctgacgatggttgaaacaccgcggaaatgaccagggcggctggccccttctaaaatggtcgatagggcaggaacatcaacatacgtttgcttttccagccccgcagggtagatatcggctgcggccggtgcgaacaccagatctgcaccgtggcgggtcagtttctcgcaatcttcctgtaaggtgcgcgggtaatgggctaagtcatctggccgttcaaattgcagcggattaacaaaaatagtcaccacgaccacgtcagcgcgggtttttgcttcatccaccagcgtcatatgcccttcgtgcaggttacccatggtgggtactaaggcaattcgtttaccttcctgacgccaacggcggatctgttgacgtagcaatggcaatgtctcaataatcagcattccctttctcctgttttaggaacgatctattttaggaggatcctattttgaaaactccctattttagaagaaatattagtggctcagttactggaatgtatgctcttcagcaggataaatccccccctcaacttcttcaatatagagcttaatggcggcacgaatatcgcccgcactgtgtgctaaaaagtttttactgaattttggcgtatgacccccggtaataccgagtgcatcatgcataaccaaaatctgaccgtcagtgacattccccgcaccaataccaataaccggtatggttaactcttcggtcacccgctgtgccagttctaccggcacgcattccagtaccaacagttgagcccctgcctgttccagggcaatagcatcttgcaacagttgattggccgccacttcttcacgaccctgtactttatagccgccgaaaatattcaccgattgtggcgtgagccccagatgcccacaaaccggcaccgcgcgctctgccaacatgcgaatggtatcgcacagccagctcccaccttccagtttgaccatattggctccggcccgcattagctctgccgcgtgggtaaaggccagttctggcgtggcataactcatgaatggcatatcggccaataacaggcaatgaggcgcaccacggcgcactgcacgggtatggtaggccacatcggcaacggtcactggcagcgtggaatcgaacccttgtaacgtcataccgagcgaatcccccaccaatagcacctgaataccctgttcagcaaataactgggcaaaactggcatcataggccgtcagcgttgcgaatttacgtttctcttgtttccattggcgtaattggctcatggtggtggttttcatcactctgtctcctgaaattaaagtgaacaactttatcaacaaacggataaaccaagacctgcccattacgggatggaatataagattatctgcaagacattctactgcaaccttggcctgacggcgaggtgggctatttttagttgataatcataatgttatatcaatataacgtaatgagtggctcaacgcacgggcagagtctggctatcgaagaataaaaagatcgggggaaatagaggatcttgccgtgtgtgagccggcgatattaccagagaaccaagccgttcttatcgacccgcttaaggcattctgatagggattcgccatcggggaaaataagatctggggcgatatctgccagtggatagagcataaattcacgcgctttcagaccataatgcggaatcgtcaggcgatcagtttttatcacctgatcgccatacaacataatatccagatccagcgtccgtggcccccagcgctgctcttttctcacccggccttggttacgttcaatcgcttgtgtgtgatccagcaactgctctggtggcaacgatgtatccagtgcgaccacggcattgagaaaatcgggttgatcctgtgggcctaatggcttggtgcggtaaagtggcgaacacgcgactaaccggctacgcggcagatgcgccaaggcttcccgtgccgcgctaacctgttgtagtggcatggccaaattgctacccagcgcgatatagacccggatcatggtaaaattatacccggggtactggcttgcgtgggcggcgtggacgtgaacgccgtggcgcaggatcagcacctaatgtattcagcatggatttctgttgcgtgggagtggcttcctggaattcgccccaccactgcgccaaacgttgcagctcgtgatttttttccacttctgcccgtaggagtaacagatcgtaagccgcccggaatttagggtgttccatcagcttatgggcacgtttcccctgacgacgtgacagacgcagttgtaacaaccagatatcccgtaccagtgaggtgatacgtttagggatagccagtgagcggcactcttcgtccagcacatcattcatggccaatgcaaatgcatcgtaataggccagaccgctttcctgcgttaacttctgcgcatgttcaatcagcggataccacagcatcgccgcaaataagaaggcaggattaacccgctgatcattatgcagacggtggtcggtatttttcagtacctgaaccagaatacgctccattggcgaatcatgctgttcagtaaaattacgggcaatcagtgggaatagcggctggaaaagctggtattcgcacagttttaaataggttttatagccgtagccggattgcagcagcttgagtgactcctcaaacaggcgggcgggcgggatttcgcgcaacagtgaggccagacgcggtataggctctgccgtttccgggctgattgacatatccagttttgcggcaaaacgaaccgcacgcagcatccgtaccggatcttcacggtaacgggtttctgggtcgccaattagacgaataataccctctttcagatcacgtaagccgccggtgtagtcacgcagcgcaaaatcagaaataccgtagtagaggctgttaatggtgaaatcacggcgttgagcatcatcttcgatggagccaaagatgttgtcacgcagcaacatgccattttgcgcctgctgggaggagttcttatcgctgtcttctgcttgttgctgctcgtggtggccacggaaagtcgctacttcaataatttcagggccaaacatcacatgagccaaacggaagcggcgaccaaccaaacgacagttacggaacagttttcgcacctgttcaggggtggcgctggtggtgatatcgaaatctttgggttttctgcccagcagcaggtcgcggacaccgccgcccaccagataagcttcgtaacctgatttattcaggcgatagagaaccttcagtgcattgtcactgatatctctgcgggagatattgtgctgatcccgcggaataatcgccatttggcgctgttccgaagacgacaccgcgtgacccttgcggccagtatgtgctctggcgggccttctctctttgcgggccacgttatcttcaccgggcactttatctttacgggccttgtcatcacggaccgttttgtcttcgcggatcagcaccttacggcagaaattggctactcgggtaaaaatggtacacctcgatagtggctaataaataacagaacgacagaaaaacagcggctaatcatagctcaccatgcttactttgagaatgccgttgtgttttctgtggggttattgccccctggagtgggattgacaccaacgtccaatgctcaacggcataacgtaataataaatacaaatcaagatcttgccagtattccggtagcggttggcgtaaaaactttaatgcgtcgattaaaataggacgtggatcgccattaggcaagggaggagcatgattctgcttggagagcttattcccctgattattcagcgccaacggcaagtgtatatagctggggacagggtgttgcaactgctgatagagcgctatctggcgcaccgtcggctcaatcaaatcagcacctcgtacaatttcggtcacgccctgaaaagcatcatccaccaccaccgccagattataagcgaacagaccgtcacggcgacggataataaaatcttcttgtgccaacgcagggtgagcatgcagttcgccgagtaatttatcataaaaagcgtaaaccggctgagtctgccgcaaacggatagccgcgccgctagcgggtaaatgacgatcacggcagtagccgtcgtagaacccgccgagctggtggatgcggctacgggtgcaggtgcagtaatagcttaatccctgctgttccagccagttgagcgtggcccgatacgcttcatggcgctgtgattgatagataaccgggccatcccaatggagaccataatgctctaaggccgctaaaatacgtgaggccgcgccaggaacttcacggggaggatcaatatcttcaatacgaactaaccacttcccgccttgagcacgggcttgcagataactcccgagtgcggcaatcagtgaaccaaaatgcaaatcccctgatggcgaaggtgcaaaacggccaacatattctgttggttgattcgttgctcgttggttagctgatcgttgattagacaactgctgattagctgatcgttgaatgaccgcttgttgaaccacaggctgttgagtctcgggaagctgggcgctgggaaattgggaagcacgtggttgagcagcagaaaatagttgagcagcagcgaatggctgagaaccgaatagctgagaacctgatggttttgagccaaatggttggggatcaaatagttgtgagctaaatagtcgttgaaaaccagtatcttcaagcataaaaagaaggggtccaacagttcaaacacggtgccggagagggctctggcaccgtgttacacattatgccgtgttacacattatgctgtgttagcctgccatctgcttttcgcggatttcggccagggttttacagtcaatgcacaaatctgcagttggccgtgcctcaagacgacggataccaatttctacgccacaagactcgcagaaaccaaaatcgtcatcttcaacttttttcagcgtcttctcgatctttttaatcagtttacgctcgcggtcgcggttacgaagttcaaggctgaattcttcttcctgcgcggcacggtccaccggatcagggaagttagcagcttcgtcttgcatatgcgatacagtacgatctacttcatccctgagctgattgcgccatgcttcaagaatcagcttgaaatgcgacagctgggcggcgttcatatactcttcgcctggcttctcttggtaaggctctaccccagcgatggcgagaatgctcaaggacgaggttttacgtttttgcccttcttgcatgatgcttctcctacattcatacgcactatcgaaatccccaatagggggaaaaatcaggccgctataaataacagaagggaggtaggttggcaattattcctgtcgcctgcttgacaatggtgtgaaggaaggcgtatttggcgagccactttacccagtaattgcttttttattcagcgttttctgatgaaagcatttcgtcctgtaataacggtaaacgggtgtttagctcgataccgtcaggcgatagttgaaaaccataacaaataacctctactcctgcctgctgagcctggactagcaactctgcatagcgacgatcaatgtgtcgggctggtgcaacttgtttgattcccgtatgcaataccgcaaagaaaagtactgcccggtggccgttgacaaccctgttttgtaattcccgaagatgcttctggccccttagagtaaccgcatctggaaaataaccacactgttgttgtaataaggtgactgatttgacttcaatatagcagtcacgtctatcttctgcctgcaataacaagtctatacggctgttctcttcgccatacttaacttcttttctgacaaaattgtaaccagataattcagcaatctgatttttttcaattgccaagttcactaactcattggcgcgcatcgtattgacacaaatccaatcaccggtttgggtctgtgtcagctcccagctctgaggatacttccgtttcggattatctgatgttgaataccagatggtatctccaggcgtagcacaacccgtcattgctccagtattcgcgcaatgaatagtcagcgcctctccagcgggcgtcacaatatcagctaaaaagcgtttgtaccgcagaataagtgtggcgggttgtaacgggggagtaaattgtagcaacgggggggtaaattgcagcaaaggggcgttaaattgcagcgatttggcgagagtcggtggcgagttcgggctaattgaccgcgaatctgagttcactgacagtaagttggcgctaaaggggggcaagttggcgttagcaggcatctggtttcctttcactgccagccagcggccagctttgtacgatgttatagcgggtgcggccccgcgcgaagaccgattcatacagcgagaaatggtccgcctggaaggtctcattgccgctcttggcaggtaatgccactgggcgggttgcgttacgcaacagagtaacatggggatgaaacggcagcggcgtttgataacagccactacgtgctgcctgggagcgcagcaactgcgccaattgcaacaggccacgaggggggttcttacatcccagccaaatcacgccggaaccgggccaatggccgatatcatctaatgtcacgctgaaacctgcttgttggatacgcccggcttgctgctgtaacacctgggcttttgtcgcactgacttcaccaaggaacgccagtgtcaggtgcagattcgccgccgcgacagggcgacccgcctctggcgagaaatggccagctcgccattgcacaatctcttgttgcatggcatctggcagtgtcagggcaaagaataggcggcggacacgttttaattcgtcaacggtatttgtcattaggttggcatgatcactcggctaaatacgctctacggtcatgatgctacaatggctgacgataaagctacagcggctgacgataaagctacaatggctaacgataaagctacaatggctgacgataaaagtagagcgtgtggagacgaatgttgtggtgagtgagagaaaaaatgatgttgcgatagcggcgttaccggtgagtgaagtgctcgacgagttgctctctgcattgcaatcctcatcgcaagtcctgcttcatgccccgaccggtgccggtaaatctacctggctgccgctacaaatcttgcaacaaagtcagtttcttaatagcgggtcaccgggccgcatcattatgctggagccacggcgactggcggcgaaaaatgtggcttaccgtttggcacaacaattgggtgaattgcccggccagacagtaggttaccggatgcgcgcagaaagcaagatcgggccggatacgcgtctggaagtggtgaccgaaggtattttgactcggatgctacaacaggatgccgagcttcagggcgtgtcattggtgatccttgatgaattccacgaacgcagtctgcaagcagatttggcgctagcgttattgctggatgtgcaacaggggctgcgcgatgatctgaaactattaatcatgtcagccacgctggataaccagcgcctttctgctttgttaccctccgctccggccattgtctcggctgggcgcagtttcccggttgaacgcagttatcagccgctctccagccatgaacggttggaagagggggttgccagccgcgttaaacgcttgctaaatgaacagcccggttccttgttgctgtttttaccgggtgtcagtgaaatccatcgagtgatggaacggctgcatggcgaggtcgccagcgataccgatttgtgcccgctgtacggtgctttgccactcagtgaacagcaaaaagcgattcaaccggccgctatcgggcgacgtaaagtggtgctggcaaccaatattgccgaaaccagtttgaccattgagggcatccggttggtggttgatagcgggctggaacgggttgcgcgttttgatatcaaaaacggtctgactcgcttggtcactcagcgtatcagtcaggcgtcaatggtccagcgcgcaggccgtgccgggcggctagaaccgggtatctgttggcatctgtttgccaaagagcaggccgaacgggcggcggaatacagcgaaccggaaatactgaacagcgatttatgcggtctgtggttggaattactgagttggggatgtcaggatgcggcgcaactctgttggctcgatcaccccccggcagcggcactggctgtggcccgtgatttattagggcgattggatgccattgatgaccaagggcagttgacggccacggggcgcaccatggcaacgctgggctgcgagcctcgattggcggccatgttgtgctttggggcggggcatagccccgatgcactggctacggctgcgttgttggcggctattttggaagaaccccctcgctctggccaaatagatttacatgactggctcagccggccgcagcctcactggcaacggcgcgccagacaactgacacaaaggcttaacgcgcgcggaggcagtgtagaccatgcgctggccgcacaattgttggcgctggcttatccggataggatcgcacagcagcgggggcaggatgggcgctacctgctggctaacggcatgggggctgccatggcgcaggatgaggcgctatcgcgatcaccctggctagtggcggttgggctactgcaaaaccacagcgggccggatgcacgtattttgctggccttgcccgttgacatcgaacagttggtgacgtgtctgccgcggcaagtggaagagcgcacggtggtggagtgggatgatgaaaaaggtacgctgcgagcctggcggcgctggcaaattgggcgtttgatcctgcgggcgcagccattggctaaaccggatgacgcggcattgcagcaggccttgctaaactgggttcgggagcaaggattacagatacttaactgggatgaacctgccgagcagctacgtacccgcttacaatgtgctgcccgttggttgccagaggcgccatggcctgcggtcgatgacgacagtttgcaggataaactggcgatctggttgcagccgtcattatccggtgttcgtgatctacgtgggcttcggcaggtgaatattgctgaagccttaacccgcttgttagattggaaacaacgccaacggctggataccgaactgccaactcattacactgtgcccactggcagtcgcctgccaatacgttattatgtcgaccggccgccggtgttggcggtacgtttgcaggaggtttttggtgaacagcaaagccctatgctggcgagcgggcgggttgcggtggtgcttgaactgctttctcccgcccatcggccattacagattaccggcgatttagcggcattctggcagggggcgtatcgtgaggtgcaaaaagagatgaaagggcgttaccccaaacatgtctggcctgatgacccggcacatacccggccaacccgcagaaccaaaaaatatcaagataagtgatatatcatggctgatagccaataaattcagatgtttctcgtttctatccggtgaattggggaacacattaagccgcaataatcaccaatgcgcgtggagataggaaacatgtctggggacgatcgtgagccgatagggcgcaagggcaagaaagcccaacccaaagcagcaccaaaacgtccactgcgccgtcggcgtgatgaagatgaatacgaagaagattatgacgaagaacaaaatgatgatgattatgatgacgaggaggagccgatgccaagaaaagtagcatcacgcccacctcgcaagaaacgccgttggctcgggttgttgatcaaactgttcctgattggggccgtggctttggcgatctatggggtttacctcgattcgcaaatccgcagccgtattgatggcaaagtctggcaattaccggctgccgtgtatggccgcatggtcaatcttgagccgggtatgtcctacagcaaaaaagagatgatcgccttgctggaagggatgcaataccgtcaggtcagccgcatgacccgccctggggagttcacggttcagaacgacagtatcgatatcttgcgccggccgttcgatttccctgatggtaaagaaggccaaattcgcgcccgtttactgttcaaaaatgatcgtctggcccagattcaaaacctggataatcagcgtgatttcgggctattccgcctcgatcccaagttgattaccatgctgcaatcacctaacggtgaacagcgtctgtttgttccgcgcgccgggttccctgatttgctggtggacaccttgctggcgactgaagaccgccatttctatgagcatgatggcgtcagcccgtattccattgctcgagccgtggtcgctaacctgacagccggtaaagcggtgcaggggggcagtacgctgacgcaacagttagtgaaaaacctgttcctgaccaatgaacgttcgctggtacgtaaacttaacgaggcctatatggccctgttgatggattatcgctacagcaaagatcggatcttggaactctatctgaacgaagtctatcttggtcagagtggtggtgaccaaatccgtggcttcccgctgggtagcttgtattactttggccgcccggttgatgaattgagtctcgatcagcaagccatgttggttggcatggtgaaaggggcctcactgtataacccgtggcgtaatcctaagctggcacttgagcggcgtaatttggtcctgcgcttgttgcagaatcaagggattatcgatgctgagctttacaccatgctcagtgcccgtccgttgggggtgcagccgaaaggcggagtcatcacacctcaacctgcttttatgcagatggtgcgccaggagctgcaacagaagttgggtaacaaggtcaatgatctgtctggcgtgaagatcttcaccaccttggatccggtttcacaagatgccgcagaaaaagccatcgaagacggtgttccggcgctgagagccgcccgtaatatgaatgacctggaagcggcgatggtggtggttgaccgtttcagtggcgaagtgcgtgccatggtgggcggttcacagccacaatttgccggttttaaccgtgcgatgcaggcccgccgtttggtggggtcacttgccaaaccaccaacctatctggccgcgttgagtgagccagataagtaccgcctcaatacctggctttcggaccaaccgctgtcgcttaaattatcgaacggttcattgtggcagccgaaaaactatgatcgccagttccgtggtcaggtcatgttgatggatgcgttggtgaactcactgaacatcccaacagtcaatttggggatgtcagtgggcttagatcagatcagcgccacactgcaacgccttgggatcccgaaatcagtcattaatccggtcccagccatgttattgggggcgattgacctgactccggttgaagttgcgcaggagtatcagacgatcgccagtggtggcaaccgtgcaccgttgtcggctgtgcgttcggttattgctgaggatgggaccgtgctgtatcagagcttcccacaggcagaacgtatggtgcctgcacaagcttcttacctgacgctgtatgcgatgcagcaaggggttgtccgtggtacatcacgctctctctcggcgaagttcggcaaatataatctggcggccaaaaccgggacaaccaacgatctgcgtgacagttggtttgccggtattgatggcaaagaagtgaccattgcctggattgggcgcgataataacggcccgactaagctgaccggggccagcggcgcgctaaccttgtatcgccgctatctggaaaaccaaacgccgttgccgctgattctgcaaccgccagaaggcattagccaaatgaacattgattcggcggggaacttcgtctgtggtgaagggagcgggatgcgcgtcattcctgtttggaccgaaaatccgcaagctttgtgtcagggatccgcacccactcaagaccccacaaaacctaacgatgatggtgttgccgattggatcaaagagatgtttggccaataaaatgtgtggtcaataaaatgtgacggcgggcgtggtttacagactgcgcccgccaatttttttctttgcgcttcccttcttcgtttcccccaacaaatcagcacggcatagcccttgcagtcctttgtgagttacgcataaactaacggttttgataattatttcgttttaataatcattatcgttaccgttcgattttcgctaacgtttgggccgcgtcctcccttgtctcccctcacctgagatcaaggcgttgggggttatcagccgtctgacgggtattccccgttaatttataatcgcgtacagcagggcactatcttggacctacaggcaagccactccagcacttttatactccgtgaactgagtttttcggttcctggtcgaaccttattacagccgctgtcactgacgtttccgcaagggaaagtctgtgggttgatcggccataacggttccggtaaatcgacattgctaaaaatgctgggccgtcatcaaccaccatcaagtggtcaggttgtgctcaacgatatgccactggcccaatgggatagcaaagcgtttgcccgcgaagtggcctatttaccgcagcaattaccggccgcagaagggatgacggtgcgtgaattagtcgccatcggccgctatccgtggcatggcgcgctagggcgctttcgtcaggaagatcgccaacaagtcgaagaggcgattgcattggtagatttgaaaccactggctaaccgcctggtggacagcttgtctggcggtgagcggcagcgggcttggttggcgatgatggtggcgcaaaacagccgctgcctgctgctggatgagcctacctccgcgctggatattgctcatcaggtggaggtcttggggctaattcaacgtctcagccacgagcgtggcctaaccgtaattgccgtgttacacgatatcaatatggcggctcgttattgtgaccatctcgtggcattgcggggtggtgagatgatcgcccaaggcccggcagatagcctgatgcagagtgcggtattagaacaaatttatggtatcccgatgggcattttaccgcacccggctggcggtgcgccggtaagttttgtttattaatgaagacacatttacccatggatctctcttcttcatcggctccgaattattcatcggatccagattgttcagtaaggccagcttgttcagcaaggtcagatcgttcatcaaggcccgattattaccggcgtcggctactgatggcattaacgttatcgccattactgctctcattgcccagtctggtagcggcggcaccgaagagcgatcagccattactcaatatagacagagtgattgatatccaaagagatatcgatactaaaagggtcgtcgcactggagtggctacctgtcgaattgctactggccttgggggttacaccgtttggtgtcgctgatatccataactatcgcctatgggttggggagcctgctctgccggcggatgtgattaatgtcggtcagcgcactgaacccaatttggaattactgcaacaaatggctccatcgctgatcctgctgtcgcagggttatggcccttcgccggagaaacttgcacctatcgcgcccacgatgagttttgcgtttaatgaacagggcagttcaccgctggctgtaggcaaaaactcattacagacattggggcagcgtttgggattggagacggctgcgcaacagcatcttgctgattttgaccattttatgctggcagcccgtgcgcgtttatctggcgacacgcagactccgttattaatgttctctctgttggatccccgccatgcgttgattatcggtaacggcagcctgtttcaggatgtattgagcaccttgaatattgagaatgcctggcaaggggagaccaatttttggggcagcgcggtggtgggtattgaacgtttagcgacgataaaaacggcacgtgcagtgtgtttcggccatggaaataatgagatgttacagcaggttgcacgtaccccattatggcaatcgctgtcttttgtacgagaaaaccaattacgtctcttgccaccggtttggttctacggcgcgacactgtcagctatgcgtttcgttcgtttactggaacaggcgtgggggaaagcaccatgagcgccataagtttacgccagggttggcggctccctgcgggtctacttggcctactggtggttattgccgtttccctgacattttataacctcagtcaattactgccttcctctctctggtctgaagccctatggcgacctgatcgagacgatgtacgccagatgctatttcattacagccaattacctcgcctagcggtggcattactcaccggagcggggctggggctggtaggggttttatttcaacaagttctgcgtaatcccctggctgaaccggccacactgggggttgccgcgggtgcccagttagggctaacgatagccacactgtggatgttacccggtggtgagttaacccggcaactggcggcaatggccggtggtatgacggttggggcactggtctttggcgtagcctgggggaagcgcctgtcaccggtgacattgattttggccggtctggtgttggggctttactgtagcgcggtgagtaacctactggcactgttcaattatgaccagttacaggggctgtttttgtggagcagtggcgcactgaatcagcaggattggagtacggtacagtttctgttaccgcgcttactgattagcggcatattggcggccttcttgattcgtccgttgaccctcttggggttagatgatggtgtcgctcgcaatctggggttagggctgtcactggcccgcctgagtgcgctgggattagccattatattcagcgccatgttggttaatgcggtgggtgtgattggttttatcgggctgtttgcaccattgttggcgaaaattttgggggcacggcgcttatcacaacgtctgatactggcccctattgtcggggcattgctgctctgggtgacggaccagggcatcatctggctgacacaagtctggcgagagatcccaaccggtgccgctacggcgctgattggtgcgccattgttattgtggttgttgcctcgcttacacagtacgactgcgccaaacatggatttgggtgactcggttccggtagagcggcagcgtttaggattatggatcagtgcgggtttgctgctgctgttggggggattgatcgtagcgctgatgtttggccgtgatagccaaggttggcgctggatcgtcggtgatgaattacaggcgctgttacattggcgctggccacgggtattggcggcactggctgccggtatgatgctggcggttgcgggaacattaattcaaaagttgactggtaacccgatggccagcccggaagtgttgggtatcagctctggtgcagctttcggcgtggtcattatgttgtttatcgtccctggtaatgcactggaatggttgttgcctgcggggagcctaggggctgccatcacgctattgctgatcatggttgttgctgggcgaggcgggttttctccgggcaggatgctattggcagggattgcattgagtaccgcttttaccacggtgatcaccatgttgctggccagtggcgacccacggatgcgcgggttgctggcatggatttctggctcaacttattctgttgagggctcacaagcgttgacgacaggcttaattgccgtggtgttgatagcactagcccctttgtgccgccgttggttaatgattttgccattaggcagtgtgaccgccagagcattagggatggctctggcccccagccggttagcgattttattattggcagccacattgacggcggcagcgaccctgaccgtcgggccgttgagttttgtgggattgatggctccgcatatggcccggatgctgggtttccgtcgtgctattccgcaactgattattgcggctattttgggcggattattgatgatattagctgattggtgtgggcggatgctgttgttcccaaatcagatccccgcaggcctattagcgacatttatcggggcgccctattttgtttatttgctgcgcaaacaggggcggtaattttatcaggcgaatgccctgctaatttgacgccgccgcgtgactcttctacctatcctcaccgtttcagatcgcgtcattgggggttgtcagcagtctgaaatctcctccggagaggagattagaggttattgacaaagtgcccgcaacgggagagaacaggcagatcgtaaagacgccggcttccctgtataaaaatagccttccctgggggctcgaaccgcgccctcccaggcgcggacgctttactcttctgcctatcctcaccgttcaagatcgagtgttcggggtttgtcagcagtctgattaccttctattttgggctaaaactcaaatagatattgttttggctaaaattcaaacaaatattgaattaaagtttagcaaagcatcgacgagcggcattgacggttttctgaatatcttcgttgctgtgagccagagacataaagcccgcttcaaaggctgacggtgccagatagaccccttcttccagcatcaaatggaagaaacgtttaaagcgctcaacatcacaattcatcacatcctgatagcaggtgacggtatcagcattggtaaagaataggccaaacatcccaccgacgtggttaaccaccagtgggatgttctcctctttagcggcatgtcgcaggcctgtagccagtgagtcggttaattcggtcagtgtttcataaacaccgacctgagagatttctgtcaggcaggcaaaaccggcagccatagcgatagggttaccggatagcgtaccggcttggtaaaccgggccagtcggtgccagcgcattcattacctcacggcggccaccaaaagcgcctactggcataccgccaccaatgattttacccagacaggttaaatcagggatgacatggtaataatcctgcgcgccagctaaggctacgcgaaaaccggtcatgacttcatcgatgataagcagagcaccaaactcatcacacaaagcgcgcagaccaggcaggaactctggcaacgggggaatgcaattcatattaccggctactggctcaacgataatacacgccacttcttgcggatattgctcaaaggcctgccgtacagaagccagatcgttataggtacaggtcagggtgtgtttggcaaaatccgcaggaacaccaggtgaattgggctgacccagtgtcagtgcgcctgagcctgcttttaccaacaaacaatcggcatggccgtgatagcagccttcgaatttaattatcttatcgcgaccggtatagcctcgggccagacggatggcactcatggtggcttcggtgccggaattgaccatccgtaccatatccatggttggcaccaaatctgtaaccaactgagccattttcacttccatctctgtcggtgcaccaaaacttaggccacgttcaacggcctcaatgaccgcctgacgaatagcagggtgattatggcccaagatcattggcccccaagagccgacatagtcaatataggctttgccatctacgtcaaagaggtaagcaccatcagcacgttcaataaagagtgggatgcccccaacacctgtgaatgcacgcaccggagagttaaccccgcccgggatcaactgttgtgcttgggcatacagattttcggatttactcataaattggctcctgaattgggcttggcaacgttattcactttggcaacattatttaccttggcaacattattatttaccttggcaacattattcatctaggcagccttagccttggtaacgtcgttcttgtgacaatatgggtcttgagaaaagaagaatgtggcttattctaaagaactgacagcggttatcaaataattgggcatatttagctgtcagtatgcgtaatgtgccgcaaatagcgatagccgtaaatgaacacgcctccctgagccagatcatttcattggctatatggcggcgcaccatgagttcatagactagactctggttacatcaaatttgtattatgtattgctcaactgataaacaaattaactatgactcattcaacgcaacaactttctcctgaaggcgtcgctgaaggcaagcgtggccgtttgatccgtgaactggttaatcgtgataagacacccttaattattcttatcatggccgctgttgtcggtgtggtaacgggattattaggcgtagcatttgatcgcggtgtcgattgggtccagcaacagcggctgctagcgctggctaatgtcgcggattccgcactcttggtgtggcctctggcttttatcatgtccgcactgctagcgatgatgggctattttttggttagtcgctttgctcctgaggctggggggtctgggatccccgaaatcgaaggagcaatggaggaaatgcggccagtgcgctggtggcgcgtaatccctgttaaatttattggcggccttgggacattgggcgcaggaatggttttaggccgtgaaggacccatggtccaaatggggggcaacagtgggcgaatgatcgtggatatttttcgtttgcgtagcccagaagcccgtcattcactattagcaaccggtgcagccgcagggctgtctgcggcatttaatgccccgctggcagggattctgtttgttatcgaagagatgcgctcgcaatttcgctacagcctagtctctattaaagccgtatttatcggggtgattacctcaacgattgtttaccgctattttaatggtgaacgtgcaattattgaggtcggtaaactcagtgatgctccgctaaacaccctttggctttatttattattaggcattatttttggtgctgtgggcgtcatattcaatgcccttatctttcgaacacaagatatgtttgtgcgctttcatggtggtgattggcgtaaattagttctgatcggtggcttgcttggcggaatgtgcggtttattagcactgcttcatggcaatgcggtgggaggggggtttgcattgatccctatcgcggcagccggtaatttcagcatcggcatgctgttgtttatttttatcgctcgggtcatcacgaccttgctgtgttttggatcgggcgctccagggggaatatttgccccaatgttggcattagggaccattttggggaccgcatttggtctgtcttgcgcgcactttttcccacaatatggcatcgaagccggtactttcgccattgcgggtatgggcgcactgtttgctgcctcagtacgtgcaccgttgactgggatcgtattggtactggaaatgaccgataattatcagcttattttaccgatgattgttacctgcctgggagcgacgttgatcgctcaatttatgggggggaaaccgttgtattcggccatcctagctcgcacattagccaagcaagagcaagcgcgtgccacggtaatagcacaagaaccggcggttgaaaataccccacaaacaggcagataatataacattagccctgagtacttgaatgaaatactcaggtattagataatcgagccatagatcaggctgccagtgtagtaacctgcaacgcgaagtagtaacctgcaactcgaacaccggttgggagtgatgaggatgagcaacgaaacagtactgcccctacagtttaccgaggcggcggcaaagaaagttaaactactgatttctgatgaggaaaacccgaatctgaaactgcgtgtttacattaccggtggtggatgtagcgggttccaatatggttttacttttgatgatcaggttaatgatggtgatatgaccattgaaaaacaaggtgttgagctggttgttgacccaatgagcctgcaatatttagtgggcggtgccgtggattatactgaagggctggaaggttctcgttttatcgtgactaacccgaatgcaaagagtacttgtgggtgtggttcttctttcagtatctaatttaccctgcgtccttggcgctacagcggtgttagctgcacttacttacctgaatcactgacctgtcgttggctttatataaataagctcatcgggattcattcgtttgctgccttgctgtaacgccaatgactttgggcataaacctgccagcaaagtaccgctaaaactaaagcatcgttaaaactaaagcatcgttaaaactaaagcatcgctaaaaaaccgtgaccatgagaatggccgcggttttttatgctcaaagatgattattcgacagtaatatctcaatgctctatttcgaaggttggtagttttaaatgccaacggattgcggcgagccgaataccgagggttatcaccatgcccaacatcatggcttgctgtaatggcatgttaaatgtatagaacgcggtggcatgcacgatcccgccaataatacaggccgtcgcataaatctcagtacgcaggatcatcggaatctcacgggctaagacgtcacgaataatcccacctccgacaccagttattacgcccatacagatagccactaatgggctggcatcggcggcaaaagctttattaaccccgataccgacgaacaccgctaaaccaatcgcatctaacaccggcaggatccattttgccgtgcgcctgggttgacgtaccagtacgatggtagccagacaggtcaccatggccacgaccagatcggtgggatctttcacccaaaataccgggccattggctaatgccatgtcacggatcgtgccacccccgacggcagtaaccacccccaaaaccagtacgccaaatggatccatacgtagttttcctgccagtaatacaccagagatagcaaataccgcagtacctaagatatccagccaataaaccagcattaatgtgactccgcgacaggggttggaatgctggccatttgttggcacagctgttgagcggccagcaggatacgtgggctggcgcgattaaaccagtcttcattcagggcgataacaggtaccacaagctgaggcaaccaaaaggcggagacgttatcgacttgcgactgcgtaccgcttaccacgatgacctgtggcttacgtgtcatcacttgctcacgactgacttgtggccagggaacccggctgtcggcaaaaatattttctccaccacagagtgaaacgacttcactctgtaaggtgtgcccggagctggtaaacagtggctgagtaccgaattgcaaaaaggtacgtttgggctgactgcgggcatagcgatcacgcagtgtgttgacgtgttgacggaattgttcagcggcctgatgtgcctgctcggggtgcgggctgtattgcgctagcttatccagatcgctggcaatctgatcgatatgcgtggggtcagagtagaaaatcggaatacccaacgccgctaattgatccagcggccgttgtggattacctccacgccaggcgaggatcagatcgggttttagtgccagaatacgctcaacgttaatgccttgccacgacgccacatgttctaactttttagccgattccgggtaatcagagtacgcactgaccgcgaccaacttatcgcccaaacctgcagcataagccagttccgtggtactgggcgataaactgataacccgttcggcagcctgtgctgggagtgttagcaggctaattagcaacactactgctgcgcgtggcagaggaaaaagacccagtggcatcattaaccgcgttgcgccaaggtggttaacatggcttcgatcattagggtcgattgtttcgccgccaccaccaagaactcttcaaagcttaggtgagatgcttgatcggcaacatcagaaatagctcggactacaacaaagggggtattaaacaggtagcaaacgtggccgatagctgcggcttccatttcaactgctgccaccgttgggaaggccgcccgaatgcgcgctaaaggctcggcgccattaatgaaagcatcaccgctacaaattaggccacggactgcattgagttttaattgttgaatacaattttctgccaacgcgatcaagtcttcatctgcgacgaaggcggcagggcaacccgccatttgaccgggctcatagccgaaagcggttacatccgcgtcatgatagcggacttcattggagaccacgatatcacccactttgaggctagaggccaggccgcctgcggaaccggtgttgatcacgaggtccggttggcaatgttctagcagcagagtggttcccattgccgccgcaaccttacctatgccagatttcagtaatgcgacatcaataccgtttagctgaccggtataaatttcacaacctgcacgcgctaatgtttgacggttttcaatccggtcacgcagcaatgtcacttcttcttccatggcgccaataatgcctactttcatatgggtactcgctgattttaaagggagggattaacctgctatttcacgctgtatagcttatcaggtaagaacatattcgggcaattcactgtcattaatgcgtaatgtgccgcagttcatgcgtaatccattgcatctactgccactaataggtatcactgttggtaagtgcatggttttgaatacagaatattcttgaatacaacatgattttgaatacaacatgattttgaatacaacatgattttgaatgcaggatggttttgaataattcagggtggttttggaatatagataaccagggggaaatatgtccgggatcgactttaagcagaaaataagtttccagcggccttttagtaagcccagttcagcagaagatgaatatgaaataacaagggtatttgaaagtgatcgtgggcggattgttaactctgctgctatccggcgtctgcaacaaaaaacgcaagtattcccgctggaacgcaatgccgccgttcgtagccgattaacccattcgttggaagtgcaacaagtcgggcgttatatcgcgaaagagatcctgaaccgctttaaacaggataaaaaaatcactgcctacggtttggataaactactcgacccttttgaaagtattgttgaaatggcctgcctgatgcatgacattggtaacccgccatttggtcatttcggtgagtcagcgatcaatgattggtttacaaaacggatggaccctaacggcggcagcggttctgaaccacaaagcacagatcaatgtcaggtagaggtgctgaagctatgtgagggagaaaccgaacttaatattctgcgcagtaaaattcgtcatgaccttagccagtttgagggcaacgctcaggctattcgtttggttcacagtttattaaaactgaatctgacctatgctcaggtgggttgtattcttaaatatactaagcccgcttattggtcagcccctattccagcgtcccataactatttgatgaaaaaacccggcttctatctggcagaggaaaattacgtcaaagaactgcgtcgcgaactcaatatggaagagtttgaccgttttccactgacttatattatggaggccgccgatgatatttcttactgtatagccgatttagaagatgcagtagaaaaaaatattttcagtgtcgaacaactctatgatcatatgagccaagagtggggggccgttacaccgggggatctgtttgataaagtcgtgggtgccgcttttcgtcaattaggccgtgagcaaggccggcgtagctcagaagatcaattctttatgtatctacgggtaaatactgtggggaaattagtccctcatgcggcacaacgctttattgaaaatctaccggctgttttttcaggctcttttaaccaggcattgttagaagattccagtgccgcttgtaagttattgcaaattttcaaacgtgtcgcagtaaaacatgtatttaaccacccagaagttgaacagcttgaattacaagggtatagagtcatcagtgggctgcttgatatttatagcccgttattagcaatgccagagaccgcctttacacaattagttgcagatgaccgccaccgtaagtatccaattgaaacacggttatttcataaattatcgattaaacatcggttagcttatgctgaatctgcagaaagaatccgtaatttaccgtccgaacaatatgagatatatgaatattattatcgtgcgcggttaattcaggattatatcagtgggatgaccgatctttatgcttatgatgaataccggcgtttaatggctgcggaatagtatgcaaaaatttgaattgtccgtttaattaattatagttttgtaaagacggacaatattttttactcttaattttcttggccctatgaacttcatcccccatatttaatcttactaggcaagacggcatacggcattagtcggccacatagtcgctatttattcatttttaatttgtatagtgagaacacgaatatatgaaaaaaacaactttagtattaagtgcattggcattgagcattggtttcgccatgggcccggtttcttccgtcgttgcggcagagacggcagcatcgagtagccagcagctccctagcctggcgccaatgctagagaaagtaatgccttcagtggtcagtatcaacgttgaaggtagtgcgcctgtaagcagtgctggtgcacgcggtatgccaccacaattccagcagttttttggtgataactcgccattctgtcaggacggttcaccgttccaaggctcgccaatgtgtcaaggggatctgggcggactagggcagggaatgccaagtaagcgggaattccgttcgcttggttcaggtgtcattattgatgcgggcaaggggtatgtcgttaccaataaccacgtggtcgataatgcgaacaagatcagcgtaaaactgagcgatggccgcagttttgatgccaaggtgatcggtaaagatccacgtaccgatatcgcactgttacaactgaaagacgctaaaaatctgactgcgattaagattgccaattcggatcaactgcgtgtcggtgattataccgtcgctatcgggaacccgtatggcttgggtgaaaccgtgacatccggtattgtctctgctttagggcgcagtggtttgaatgtagaaaactatgaaaactttatccagactgatgcggcgattaaccgcggtaattccggcggcgcattaatcaacctgaacggtgagttgattggtattaacaccgctattctggcaccggatggcggtaacattggtattggctttgctatcccaagcaacatggtgaagaacctgacatcacagatggttgagtttggtcaggtaaaacgcggtgaactgggcattatggggaccgagctaaactctgaactggcaaaagccatgaaggttgatgcgcagaaaggtgcctttatcagccaggtcgtgcctaaatctgctgcggcaaaagcgggtatcaaagcgggcgatatcattgtcagtatgaatgggaaagccatcaatagttttgcagggttccgcgccgagatcggcacgttacctgttggcagcaaaatgaccttgggtctgctgcgtgatggcaaaccgatcaatgtgaatgtcgtcctggagcagagcagccacagtcaggtggaatccggtaatctctacaccggtattgagggggctgaactgagtaacagcaacgttagcggcaagaaaggggtgaaagttgatagcgtaaaaccaggcactgctgcggcgcgtatcggcctgaaaaaaggtgatatcataatggggattaaccagcaaccagtccagaacctaggtgagctgcggaaaatcctcgatgctaaaccaccggtattggcgttgaatattcaacgtggtgatacttcactctatttattgatgcagtaaggtattgatgcagtaaggtattgacacaatagatgcagtaacgggtctcaatgcagtaaagattatgtagatcccgtgtgatttccatttagctcaagggcacagtttatctcgctgtgccctttttggttttctatttccacaagcgttcgaggatatcactctgtacgtaaataggttttagccgcttcgctgacattttctatctcatccagcaactcaagccactcgggttctaaatcctgcaaattaacctgctggcgcaactgtagttcaatggtcatgcacagttgtctgaggcgtggcacaccgctacaggcgcaactgccatggaatttatgcaccaaattcagaatgtcgccatcgtcagcccctgccagaatcgcctgcacacgggcggtaatctgcggcataaattctagcaacatggttaagagatcccgtgccagatcctctttattggcggcttgcctgacagcctgtgcccaatctatgaccccagcacctttaggcacgggaagtggcaggctttctgctgtagatgctgtagatgctgtagatgctgtagatgctgtagatgctgtagatgctgtagatgctgtagatgctgtagataatggcggattatcgctttgatagcgggagagtacctgtagcagccgtgcttcatcaataggctttgccagataatctgccatacccaatcttaacaattgctcttgctggcctttaacggcatgggcggtgaccgcaatgattggtgtctcttggtgatgcggtatctggtgaataatttcactggcacggataccatcgatttctggcatttgaatatccattaaaatgatatccagcgtgtgctcacgcgcataggtgatcgccatggcaccgctgtcgcacagtaccgtttcctcaatttgctcttcaagcagggtacctattagcttcagattcgcagggttatcgtcgacagccatcaccctgaaaggtaactttggttgcttacgtggttgctcctcggatggtactttactatgcgtgtcttcggccaagagtaaagggataagcctgatagatgatatgggtttcagcaggcaacctttggctccgatttgcttaagttgctcggcttctacttgcgattggcttggtagtgccaagatgacatggtcggcaatttttagggctgttagcaatttatcttgatgaattgccatgttatttctaaatgggatcggtaccccgaccagcaggaaatcataatgttgttcaggtaactgagctaaagactgacgatgagtcacctgcaatggcgtggtgttgagtatatttatcgtcgctctcgccgccgtagaattacgctcaatataagccagttgtttcccctctaaatgcgccatatcaggttggcggtaagggatactctcgttaagttctaatgtgaggtgaaatctgaagattgaaccgcaactcatttggctttggaaactgatattaccgcccatttctttcactaaccgttcggtaatcaccaggccaagcccggtacctccatggcgtcgagaggtactggcatccgcctgacggaaagcctggaataactgcgcttgctgggattcagaaataccgataccggtatcgtggatctctaccatcaatgtcacttgctgtgatgcgatagccttcacgacgaccagaatgtcaatattgccctcttcggtgaatttaatcgcattacccagcaagttagtgacgatttgctgcaaacgcatggcatcgcctaacacttggtctggtacgtcattattgatatgtaacgtcagctctagccctttttcatgggcggtatgtgccagcaaaataatgacttcatctaacgttccacgtagcgaaaagggaatatgctcaagtatcagtttatcggcttccagtttggagaaatccaggacatcgttaatgatgcataacaggttgttggccgaacgctggatggtttgtaaatagtcagtttgtgtcggtgtcagcgaggttttcagtgtttgtcgggtaaaaccaatcaccccattgagtggtgtacgcagctcatgggacatattggctaggaactccgatttaattcgagaggcttcttgagcacgctttttcgccagccccaattccacattctggatttccatttgttcgagtgtttcgcgtaagtccgatgtcgcttgatcaatattctgctgcatctcttcatgataggccgcgagtgacatcgccattgaattgataccatttttaagaatattcaactccccgagcatatggccttcaacccggctgtctaattgcccgcggcgaatacggtcgacggtattgaccatattgcggatagggccggtgacatctcgcatcaggcggtaagcaaacaaaatggcgacacacatacagaacagcagtagcaaagttgaaatgaatatttctttatattgtttcaggcgcactgattgtaaatctaaatcaatggcgatatagcccagtatctggtcactttccccctgcccggaggcttgttcactggataaattagattcagagacaatgggcattcgtaggatcagcgaatccccacggtacgaaagcatcaaagaatcggggacgggttcgcctggagggagtcttaattgtgaggaattgtaattgtagttggatgtgacaaaaagcttattatctacgtcaaaaacagaaattgaccgaacaatattcgagtgccttcggtgtagtagattaatcaactgtcgaacggtgtcgcggttgcggaagctcatcccgtattcactggcaacggccaacggttcaataatattggtgccggcactaactatttggttttgcagctcattatagcgattgaccataaaggatgtactgagtaacagccctagaagcagcgtgggtgccaagattaaaatcatcatgcgcgcgcgaagactgtatttggtcatggtattccaatgtgggagaatgggtgactaatgaaactgatgcttgatcaatcaatgtggtgcaattctactctccaaacaggcgtgtgacgacccggtaaacaataactgtgacagtatattttcttggcccctttacgttagggcctgtactccatcagggagtgatcgtttttatccctgatatcttaccgggagggcgagtttatcttgctgctggtagcctgtttggtaagccgttgagggtgaaggagttgcggcgtttgtcgctaatgggctgtataatgcgttaagcaataatttacccaatgcgccatgttttatcaggagtgggttatcgtcttgctcaggtgcgtacgttggatatgttcccgcacaccgggcatcttgaatctatggcgctgtttattcaggcgtcagaggtcgcaaagtagggagaagttatggttgcggtacgaagtgcgcatttaaacccagcgggtgagtttgctcttgacgattggattgccagtttagggctggccaatccgcagtcatctgagcgattagccgaaacctggcgttactgtgaacaacagacgcaaaaccatcccgatgcctcgttattactgtggcgcggtcttgaaatggttgaaattctttccactctgagtatggataacgacagtatgcgcgcggcgctgctgttcccgctggtagacgccaatatcgtggacgaaactaccctgaccgagcaattcggtaaggggattacgtatctggtacacggtgtgcgtgatatggatgctatccgccagttaaaagccactcacaacgattccatgagctcggagcaagtggataacgtgcgccgtatgttattggcgatggtggaggatttccgctgcgtggtgatcaagctggcagagcggatcgctcatctgcgtgaagtcaaagatgcaccggaagatgaacgtgttctggcggctaaagagtgttccaatatttacgcaccactggcgaaccgtttggggattggtcagattaaatgggagttggaggatttctgcttccgttatctgcatccagatgaatataagaaaatcgccaaattactccacgagaggcgtattgatcgcgaacaatttattgatgacttcgttgcttcattacataaggcgatggccgacgaaggcattaaagccgacatttatggccgaccgaagcatatctacagcatttggcgcaaaatgcagaaaaagtcgctggccttcgatgagctattcgacgtccgcgcggtgcgggtggtggtggaacgcttgcaggattgttatgccgcgttagggattgttcacacgcacttccggcatttacctgatgaatttgatgattatgtggccaaccctaagccaaatggttaccaatcgatccataccgtggtgcttgggccacgaggtaaaacgttagagattcagatccgtacccgccagatgcatgaagatgccgagttgggggttgctgcgcactggaaatataaagaaggggccgtggcagcgggccgttcgagttatgaagggcgaattgcctggttacgtaaattgatcgcctggcaggaagagatggctgattctggcgaaatgctggatgaagtgcgcagccaggtatttgatgatcgggtgtacgtgtttacaccgaaaggcgatgtgattgacctacctgccggctcgacgccgctggattttgcctaccatattcatagcgatgtgggccaccgttgtatcggtgccaaaatcagtggccgcattgtgccgtttacttatcagttgcagatgggtgatcaaattgaaattatcactcaaaaacagccaaacccaagccgtgactggctgaatcctaacctcggttacatcacgaccagtcgcggacgttccaaaattcataactggttccgcaaacaagatagagataagaatattctggctggccggcaaatgctggatgatgagctggagcatctggatatcagtctgaaagaggctgagaagctgcttgttccgcgttacaacatgaattcgatggatgaagtgttagcggcgattggggggggggatatccgtctgaatcagatggtgaacttcctccagggcaaactgaataaaccaacggcagaagaggctgatttagaagcactccgtcatctgaataacaagcatcagcccgcgccacgtaacgccagcaaagacagtgggcgtattgtggtcgaaggtgtcggtaacctgatgcaccatattgcccgttgttgccagccgatccccggtgatcaaattatcggttttatcacgcaagggcgggggatatcgattcaccgtgcagattgtgagcagttggctgaattggaatcccatgcaccggaacggattgtcgatgcagtctggggcgaaagctactccagcggttattcgctggtggtgcgggttacggctaatgaccgcagtgggttattgcgcgatatcactacgatcctggcaaatgagaaagttaacgtactgggcgttgccagccgcagcgataccaaaaagatggtggcgactatcgatatggatatcgagatctataacttgcaggtgctgggccgggtattggccaaactgaatcagttgccggatgtcatagacgcccgtcgcctccatggcaattaggttttttaatctggacggcgattacgctttgctctattgatcttgcgctttgctctattggttacgctttgctctattgatcttgcgcggtgctcgccctcctcatgtaccggtttttataagatcgggtatacatttcgggggcgtggcgggccgcaatcaatctgcctgtgctttcgacgctttgaatttaaaaaacaaaaaaagtgaataaattgaaatgactcaacctgttacttcccctgattctacagcagtcgccctgcaacgtttattggatattatgcgcgctctgcgtgacccagagcaggggtgcccatgggatcgcaaacagacctttgacaccatcgccccttatacgttggaagagacttacgaggtgcttgatgcgattgcgcgcaaggactttgatgaccttcgagacgaactgggtgatttgctgttccaggtggtgttttatgcccaaatggggcaggagcaagggctgtttacctttgatgacgtttgccatgcgattagcgataagcttgagcgtcgccatccccatgtcttctctaatacgtctctaaacgtcactcaggcggcggttaacagtgaggccgctctggcgggctgggaatcacgaaaagccgaagaacgagcagaaaaagcattgtattcggcattggacgatattcctgatgcattgcccgccttgatgaaggcccataaaattcagaagcgttgtgcgtcagtcggttttgattggaacacgctagggccggtactcgataaggtctacgaagagattgacgaggtcatgtttgaagcgcgtcaggcagtcgtcgatgaggacaaattgggagaggaaattggcgatttactctttgccacggttaatctatcgcgccatctgggccataaagctgagaatgcgctacaagcggctaatcgtaagtttgaacggcgttttcgtcaggtagaacaaatagttacggcatcaggtcaaaccatggagagtgcgacgcttgatgaaatggaagccgcctggcagcaagttaaaaagcaagaaactgaaatgtaaggtgttttaattcatttcactgatagttgtggaattttaattacgttaatatattgaattataacggatagcaagacggtgttctgtgcggttttagtcgtgaaaaccgccatgggtgcggagatcatttgtagcgaaaccaaggttccggtatactactttcccgtcctggtacttccatcgtctttaaacctaaactctcaggttcagcatgacaactaattatatttttgtgaccggcggggtcgtatcctctctgggtaaaggcattgccgcagcctccctggcggctatacttgaagcccgtggcctcaacgttaccatcatgaaactggacccgtatatcaacgtggatccgggcaccatgagcccgacacaacacggggaagtttttgtcaccgaagatggtgctgagaccgatctggatttagggcactatgagcgcttcattcgcaccaaaatgacccgtcgtaacaacttcaccactggccgtatctattccgaagttctgcgtaaagaacgccgtggcgactatttgggtgcgactattcaggttattccccacatcaccaatgcaatcaaagagcgcatcattgaaggcggtgaaggccatgatgtggtattggtcgagattggcggcactgtaggggatatcgaatccctgccattcctggaagctattcgtcagatggcggttgatgttggccgcgagcatactctttatatgcacctgacgctggttccttatctggctgctgccggtgaagtcaaaaccaagccaacgcaacattcagttaaagaactgctgtctatcggtattcaaccggatgtgctgatttgccgttctgaccgtgccgttcctgctaatgaacgtgccaaaattgcattattctgtaatgtgccagaaaaagcagttatctctcttaaagatgttgattccatttataaaatcccagggctattgaaatcacagggccttgacgattatatttgtaaacgattcagcttaacttgtcctgaagcaaatcttgcggaatgggaacaggtattatacgaagaatcaaatccgggtggcgaagtgaccatcgggatgatcggtaaatatgtagaattgccggatgcctataaatcggtgattgaagcattgaagcacggtgggttgaaaaatcgtctgaccgttaatattaagcttattgattcgcaggatgttgaaacccgcggtgaagagatgcttaaagagcttgatgctatcttgataccgggtggtttcggctaccgtggcgtggaaggcaaggtcttggcggcgcgttacgcccgtgaacacaatattccttatctgggtatttgcctgggtatgcaagttgcgctgatggagttcgcccgcaatgtggcgggaatggaaaacgcgaactctacagaatttgtgccagactgtaagtatccggtggttgcattaatcaccgaatggcgtgatgaagacggtaacgttgaaatccgtacggaagaaagcgatttgggcggtaccatgcgcgtaggggggcagcaatgtcacctaaccgagggaagtttggttcgtcaaatgtatggcgaaccgaccatcgttgagcgccatcgtcatcgctatgaagtaaacaatatgttgttgaagcagattgaagctgccggtttacgcgtggcggggcgttctgcagataacaaactggtggaaattatcgagttaccagaccacccgtggtttgtggcttgtcaattccatccagaatttacttcgacgccacgtgatggtcacccgttgtttgccggctttgtgaaagcggctggtgattatcaaaagcgccaggtgaaataaaatatttggtggtagggggcggctgagatgtcgccccctctgtctggagttttagtttaacttgtactgaggaaaatctaatgtccaaaattgttaaagtcatcggtcgtgaaatcatcgactcccgtggtaatccaactgtagaagccgaagttcatttagaaggcggtttcgttggtttggctgcggcaccatcaggtgcttctactggttcccgtgaagcactggaactgcgtgacggtgacaaatcccgtttcttgggcaaaggcgtactgaaagccgttgctgcagtaaatggcccaattgctcaggcagttatcggtaaagatgccaaagatcaggccaacatcgataaaatcatgatcgatctggacggtactgagaacaaatcccagtttggtgctaacgccattctggctgtttctttggcagcagcgaaagcagcagcagcgtctaaaggcatgcctttgtacgagcacattgctgaattgaacggcaccccaggcaaattctctatgccactgccaatgatgaacatcatcaacggcggcgaacatgctgacaacaacgttgatattcaagagtttatgattcagccagtcggcgctaaaacgttgaaagaagcggttcgcatcggttctgaagtgttccaccacctggctaaagtactgaaagccaaaggcctgaacacggctgttggtgatgaaggcggctatgcaccaaacctgggttctaacgctgaagcactggctgttatcgctgaagccgtaaaagcagcaggctacgagctgggcaaagacgtcactctggctatggactgtgcggcttctgagttctacaaagacggcaaatatgttctggctggcgaaggtaacaaagccttcacttccgaagaatttactcacttcctggaagacttgaccaagcagtacccaatcgtctccattgaagatggtctggacgaatctgactgggctggcttcaaataccagactgaagtcctgggtgacaaaatccagttggtgggtgatgacctgttcgtaaccaacaccaagatcctgaaagaaggtatcgagaaaggtgttgctaactctatcttgatcaaattcaaccagatcggttctctgaccgaaactctggctgcgattaagatggcaaaagacgcaggttacaccgcggttatctctcaccgttcaggtgaaaccgaagatgcgactatcgctgacttggcagtcggtaccgcagcaggccaaatcaaaaccggttctatgagccgttctgaccgtgttgctaaatacaaccaactgatccgtattgaagaagcgctgggcgaccgcgcaccattcaacggtctgaaagaagttaaaggccagtaattactgcgctctactttcttaatgagttgattaagttaactggttgatttagttaactaattaattaaaaacccgcttcggcgggtttttttatgtgttgattttgctgattgataaaatcagatgctggcttgcttagatccgctcaggttggtttatcgtaaaaccccacctacctaactctatggctttatccatatttcgaccaccaactaaaacttttcctaaatgaaacacaaattcaacaaattcaacaaaacgtgacaacttttgtgtgcgggagtatgaagcataagtaataattaatcgtcaaaagtttcctattgacaaggttaaaccagacttaatcaacatataagggatataacaatatgaaattaagtacattattgctacctgttattctttactccagcgcaacactggccgctaacatggctggcatgaatgataaggccagcatgaatgataaggctagcatgactgtgaaaatcaacgaatcattgccacaaggtaatgggaaagcgcttggcaccgtgacggtgactgaaaccgcttatggcttactgtttacgccacatctcactgggctggctccgggaattcacggtttccatctgcatgaaaaacccagttgtgctccggggatgaaagatggcaaggcagtgccagcattggcagccggggggcatcttgacccaaataagaccggggtacaccttggtccttacaacgataaagggcatctgggggatctgccgggattggtggttaatgcagatggcaccgccacctatcccgtattggctccgcgcctgaaatcgttgtcagaggtgaaacagcatgcgttaatgatccatgctggcggtgataattactctgatcatccaatgcctttaggcggtggtggcgcacggatggcatgtggagtcattgagtaaccgtctgatacagttaaactggctacccgagcgtagccagtttggtggaggccgggtaatctgcgataatcggtcactgatttgaataacgatagagatactgatgctgtacccgattaatgaaatgttccagacgttgcagggcgagggttatttcactggcgttccagcgatttttgttcgcttgcaaggttgcccggtaggttgtagctggtgtgacaccaaacatacctgggaaaaagaagcggatcgggaagtcgatatgcagcgcattatggtgaaaaccgcagaaagtgatgcctggggttcagccagtgaacagcaactgttagatcttttcgctcagcaagggtataccgcccgccatgtggttatcacgggtggtgagccatccatttacgatctccagcccttaacgtcactgttggagcaagctggcttcagttgccagattgaaaccagtggtactcatgaagtgcggtgttctgcccagacttgggtgaccgtttcaccaaaagtgaatatgcgcggtggcctaaaaatattgtcacaggcactccagcgtgcggatgaaattaagcatccggttggccggttacgagatatcgaagcattagaagcgttactggcgacgttggatgatgataaaaaacggattattgcactgcagccgataagccagaaagaggatgcgaccaagttgtgtattgagacctgcatcgctaagaactggcggttgtcgatgcagacacataaatatctcaatatcgcttgatacccttcgtccttgacgctgtcgcggttttagctggatggaaggttagctgtgctcactcactggcagaaattttttacccgcgataaacgcagccagcagagcaggtctctttgatcatcaccgcactgagttctggcaattggggtttaagttgttgccaaatccaacgggctaaaacttcgctggttgggttttccaagccaggaatatcgttcagataatgatgatcaagacgttcccaaatgggttgaaacacggcttttagggcggcaaaatccatcacccagccagagtgagcatcaacttcacccgtaacttccaaacgaaccataaatgagtgaccgtgtaaacggccacatttatggccttcaggaacatgcggtaaccgatgtgccgcctcaaactgaaaatctttaaatagggtggtgctcataatcatgaccttattgactcaaaaatccgccgcatagtaccggaaagcaccggtactggctatgatcgcgcgtcatatgaatccttatttcgctcaccgtactccggttttattgacatagcttgctgatttttatgcagacatagcaatgttgccacctattgtaagcgccagaaaatttccctaataacctgaacactttaactcatatcgattacctgaaaaattgcttagtcgttttggttatttattatttctatcgcttctttaattgttattctcaggatggttaaccttacaaactatcaagactttgtggcacgaattgtcctgcctatattgacaaatatttgtgccaaccacggctaaagcataagggaattcgtactgcaatgacgactcaggctcctccaacttcgttacttccgctatcgccagagcagttggcccgcttgcaagcggcggtgggtgaattctccccaacccaaatggcatggttgtcgggttacttctgggggatggttaaccagcagcccggcgctgttgcttcccctgcggtagcggcacccccaccagtgacagttaccctgatttccgcgtctcaaaccggcaacgcccggcgtttagctgaacaactgcgcgatgatcttctggctgcccaacttagtgtcaatctggtcaatgcgggtgattataagtttaaacaaattgcgcaggagcgtttactggtggtggtcgcatcgacccaaggagagggggagccagcagaagaagccgtcgcactgcataaattcctgttttctaaaaaagccccaaaattatcggagaccgcatttgctgtctttggcttaggtgacacctcttacgaacacttctgtcaggctgggaaagattttgatagcaagctggcagaacttggtgctcaacggttactggatcgtgtcgatgccgatgttgaatatcaggtacaagcacagcagtggcgtcagcaagtggttgccacgttgcaggctaaggttccagcacaatctacagctccaacacaatttatagctccaacacaatttatagctccaacacaatctacaactccagcagcagcggcgataacgtctggtggtaccactaccgttagtccgtacagtaaaaccgcgccgttgaccgcacagttatccgtacagcaaaaagtgactgggcgtaattcagaaaaagatgttcgccatattgaaatcgatttaggtgattcaggactgcgttaccaaccaggcgatgctttgggtgtctggtttgataatgatcctgctttggtcgaagaactgctcgcgctgttgtggctcaaaggtgatgagccggtcagtattgacggacaaaatatgccactggcacaggcgctgctcagtcaccttgaactgacacaaaatacgacgctgatcgtcgataaatacgccgcgctatcacgcgatgaaaccttgattgcactgctggcagataaacccgcgttgcaactgtacgctaagaatacgccattcgttgatatggtgcggcaggcaccgtctgatcttaatgccgatcaactggtggggttattgcgccccttaacgccacggttgtactccatcgcctcttcgcaagctgagaccgaaaatgaggtgcatatcaccgtgggtgtggtgcgctatgacattgatggccgagcgcgcagtggcggtgcttccggctatctggcggaccggctggaagtcgatggcgatatccgtgtctttattgaacacaatgataatttccgtttgcctgctaacccggaaacacccgtcatcatgatcgggccaggcaccggtatcgcgccgttccgcgcctttatgcaacagcgtgaagttgatggggccagtggcaagaactggttattcttcggtaatcctcatttcaccgaggattttctgtatcaggttgaatggcaacgctatgtcaaagaaggcgtgttgacgcgcattgatctggcctggtcccgtgatcaggcgcataaaatatacgtacaagacaaactgcgcgaacagggcgcggaactgtggaactggatacaacaaggtgcccacatttacgtctgtggcgatgctaaccgcatggcgaaagacgttgagcaggttttactggacgtggtggctctgcacggtgcaatggatgccgagcaggctgatgaatatttaagtgagttgcgccaagcgcgccgctatcagcgagatgtgtactgatgaatgaaaaacacccagggccactcgtcgtcagtggaaaactttctgatggcgagcgcatgaagtcggaaagcaatttcttgcgtgggactattgcggaagatttgaacaatggactaactggcggtttcagcggcgataattttctgttgatccgttttcacggcatgtaccagcaggatgaccgtgatatccgcgctgaacgtgctgagcagaagctagagccgcgccatgccatgatgctgcgttgccgcttgccgggtgggattattaccccgcaacagtggttaggtattgacaagtttgccgctgataacaccctatatggcagtattcgcatcactaaccgccagacctttcagttccatggcattttgaaaggcaatgtgaaacccgcacatcaattgctgaatgagttgggattagatgcactggcgacggcgaacgatgtaaaccgtaatgtgctgtgtacttcaaatccggtggaatcggccttgcatcaggaagcctacgaatgggcgaagaagatttcggaacatttattaccacgtacccgcgcatatgccgaaatctggctggatgcggaaaaagtcgcgaccacggatgaagagccgatcctcggtgcaacgtatttacctcgtaaatttaaaacgacagttgttattccaccgcagaatgacgttgatttgcatgccaacgatttgaactttgttgcggtggcagataaaggcaagttgattggatttaacgtgttggtgggggggggattatctattgcccatggcgataagaatacctatccgcgcaaagccagtgaatttggttacatcccgctgaaacacacgttggcgatagcggaagcggtcgtgacgacccagcgtgattggggcaatcgcacggatcgtaaaaatgccaagaccaaatatacgctggagcgggtgggggtagagaccttcaaagcagaagttgagaaacgagctggcgttagctttagtgcgatcaaaccgtatcaatttaccgggcgcggtgatcgtatcggctgggtgaaaggtgttgacaaaaagtggcatctgacattatttattgaaaatggtcgtctgttggattaccccggtcgtagtctgaaaaccggagtggctgaaattgctaaaattcatcagggcgatttccgtctgacggctaaccagaacctgattgtggcaggcgttccggaaaaagataaagcccggattgaggcactggcccgtgaacatggcttgatggatgaccatgtcacttcacagcgtgaaaactcgatggcgtgcgtctctttcccaacctgtccgctggctatggcagaggctgaacgcttcctgcccgagtttgtcacccgtgttgagggtattttgcagcaacatggcctggcggatgaacatattgttctgcgggtaaccggttgcccgaacggttgtggccgtgcattactggccgaggtggggttggtgggcaaagccgttggccgctataacctgcatttgggcggtaaccgcgaaggtacccgtattccacggatgtaccgtgagaatattaccgcagatgaaattctgcttatcactgaccaactggttgggcgctgggctaaagagcgtcatgtcgatgaaggttttggcgattttgttattcgtgcaggggtcattgcaccagtgattgactctgcccgtgacttttacgacgtacaggaggcgatgtgagtcaatttaatctgagcgaactgaatgcgttgccgaaagccaagcaagcggcagcgctggtgctggtgaatggtcaactcgagcatttgaccgcgcaggagcgtgtcagttgggcattggataatttgcctggcgaatttgtcctttcctccagttttgggattcaggctgcggtttgtttgcatctggtgacccgtcagcgtcctgatattccggtgatcttgaccgataccggttacctgttcccagaaacatatcgttttattgatgatttgaccgagaagcttcaacttaatttacaggtgtttcgtgccgcacacagccctgcctggcaggaagcccgttatggcaagttatgggagcagggggtggagggtattgagcgttataacaccctcaataaagttgaaccaatgaatcgggcgttggaggctttaggtgcgcaaacctggtttgcgggtttgcgccgtgagcaatctggcggccgctcacaattgccggtattggcgcttcagcgtggcatatttaagctgttgcctattattgattgggataatcgccaagtttatcaatacctcacacaacatggcctgagttatcacccactgtgggagcaaggttacttatctgtcggcgatacccatacaacccgcaaatgggaaccgggcatgagtgaggaagaaacccgtttctttggtctgaaacgcgagtgtggtttgcacgaaggttaagtgtaatgtctatggctcattaagagggcgctaagagcgcccccagactgctgacaaaccccgatgacgcgatcttgaacggtgaggataggcagaggagtaaagcgtccgcgccaaggatggcgcggctcgagcctacatggatgtatttacggcgtctttacgatctgcctgttctttccgtcgcgggcactttgtcaataacctcagggcgctaagatcgcccctcttttttaccgcgattagctgatgattttctcacgggctagctcggccagaaactggctacgatttttatagccgcggttggtggcaatgaacttatcaatcgcagtcagtaaattttgcgacatggttagattaaatttgacggccttactttcatatttagccgggtcaatctcaacaaagcccagaatgccaccctcttcttttaaacgcggatcgtcaatatagcggtgcggatctttgggtgggctaggcaatgggaaaccttcattcattagcgcttcaatatggacggcaaaagcttcttccgcattcttgctgatatcggcaaaggtattccctgcgaaaaaacagccgtcaatatcggggaaataaccgtcgaatccttcaacggttttgaagatgaaaatagggtagatcatggttagctccctaagctgtttatctccgtcatacttcaagttgcatgtgcgttggttgccttcgctcatccccgtcactgactggtcgttgaccttaaaatacataagctcttggggattcgctcggtttgccgctttcctgcaactcgaattatttagggtatgcagcgttgtttaactcaatttaattccggcaattttctgagcctgtctcagtaaacctttggatatatccttacgtgggtaaggtagcgtaatgattttgcgtacaccgggtttgcacagcgtgacatggctaccactattcgtttttctgcctcctctgatttgccatcctgcatcctctaagcgttttattaattcgccactctccatgtgaaccccctggtgagctacttgtgggtatcatacctacaagtagtattgagtcaattagttataggtgtaatacccaccaattcttatacgtgaaaaacacggaaaagggcgatcataatgatcgtccatgccttgaatttattggtttttttatccattttgcgcaatatctcgcaatcgggaattattttttaggtatcgcgaatgtttatcgtcgtggtaacaggatccttgcactctcgcaggtctgtttactgatgcggccgggtcagtacgtagccaaatagtttacattattcaaatcttcatcactgtgcggtattaaccgcactcacgccaatggctttaaaactcacgctaatggctgtaaaactcacgctaatagccgtaaaactcctgccaataacgtcaggaaagctgtctaaaataccgacatttttgtcagcccataagaaaataacgtattgtgatagcccgctaacttagctgtgagccttactattacgcctatatatcattatggaacttgtaattacttttcgtcatttcataaggtcatggcccccccctatagtcaccctacgctttatcatgtaatcgaaggctgttgtggactatctacctctatttgccgacttgaaacaacgcccggtattgatcgttggcggcggcgaagttgctgcgcgaaaaattgaactactgcaccgcgcaggtgcgcaggtatgggtagtggcgcaaaccctctcatctgaactcgaacagcagtatcaggatggccgtatccattggctggcacaggattttctgcctgaacagttggacaacgtgtttctggtgattgccgcaactaacgataccgtactgaatgccgctgttttcgcggcggcagatcaacggtgtattttggcgaatgtggtggatgaccaacccctttgttcgtttattttcccttcgattgttgatcgttcaccgctggtggtcgcgatctcgtcttccggccaggcaccggtgctggcgcggatactgcgtgagaagttagaagccttactgcccactcgtctcagtgatatggccgctatagctgggcgctggcgtgggcgggttaagcagcatatggcctctatgggggagcgccgccgcttttgggaacatgcattcagcgggcgctttgccagccttatcagccgtggtcagttaaccgaggctgaaaatgaattacaactgtcgctagagggccaacaccgtgcactcggcgaagtggctttggtcggtgcaggtcctggcgatgcagggttattaacgttacgtggtttgcaagtgatgcagcaggcagatgtggtgctgtatgaccatttagtcagtccggaagtcttggatttggtgcgtcgcgatgctgaacgcatctgtgtggggaaacgggcgggggcgcattcggttacccaagaggcaaccaatcagttgttggtcactctggcacagcaaggaaaacgggtcgtacggctaaaaggtggcgatccctttatttttggtcgggggggggaagagttacaagttgtggcgcaagcggggatcccgtttcaggtggtaccgggggtgacggctgctgcgggggcgacagcctatgccggtattcccctgacacaccgcgatcatgcgcaaagcgtgacatttattaccgggcattgccgtcctgatggcgatgatcttgattggcaggcgctggcccgtggtcgtcagacgctggcgatctacatgggaacagtgaaagcggcggcaatcagccaacagttgatcgcccatggccggtccagtaccacgccggtggcagtgattggccgtggaacccgtgtggaccagcaggtgctgatcggtacgttggcacaacttgaatcactcgcacagcaggcaccgacaccagcactactggtgattggtgaagtggtgaatttacatcaccaaattgcctggtttgggcaacaaccgcagactgaatcggcgatcagcccatcagtcgtgaatttggcataaaggatctgttatggacgaaaaacgactcactcatttacggcaattggaggcggagagtatccatatcatccgtgaagtggccgctgaattcggtaacccggtgatgctctattctatcggcaaggactcctctgtgatgctgcatttggcgcgcaaggcattcttccccggtcatttaccgtttcccctattgcatgtggatacgggatggaaatttcgtgagatgtatgaatttcgcgatcacacggtcaaagagtttggctgtgagttgttggttcatcgcaatccggaaggggtggcgatggggattaacccctttgtccacggtagtgccaaacataccgatatcatgaaaactgaaggtttgaagcaggcgttgaacaaatacggttttgatgccgctttcggtggtgcgcggcgtgatgaagaaaaatcccgtgccaaagagcgtatttattctttccgtgaccgtttccaccgttgggatcctaaaaatcaacgtcctgagctgtggcacaactacaacggccagattaacaaaggcgaaagcatccgcgtattccctctgtccaactggaccgagttggatatctggcaatatattttcctcgagaaaattgagattgttccgttgtatctggcgaagccacgcccggtagttgaacgcgatggcatgttgttaatggttgatgatgatcgtatcgatttgcagccaggtgaagtcattgttcagaagaaagtgcgtttccggacgttaggctgctggccgctgacaggggctgtcgagtctgaggctgaaaccttaccggcgattatcgaagagatgttgatctctaccaccagtgaacgccagggtcgaatgatcgaccgcgatcaatccggctccatggagcttaaaaagcgtcagggatatttctgaggagcggcccgatgagcacgatattgcaaaacaagcagacattaccaagtgaacctattgctaaaaatcagtcagcattagaaagtaactcaatgattttacagagcaactcgattgcacagcaaattgctgatgaaggcggagttgaagcctacttacatgctcagcagcataaaaccatgctgcgttttctgacctgtggcagcgtggatgatggcaaaagtaccttaatcggtcgcttgctgcatgatacccgccaaatctacgaagatcagctctcgacgctgcacactgacagcaagcgtatcggtacacagggtgaaaaactggacctggccttgctggtggatggcttgcaggccgaacgcgaacagggcattaccattgatgtggcttatcgttatttttcgacggaaaagcgcaaatttatcattgccgatacccctgggcatgagcaatacactcgcaatatggccaccggtgcgtctacctgtgatctggcgatcctgttgatcgatgcgcgcaaaggggtgttggatcaaacccgtcgccacagctttatcgccaccttgttggggattcgtcatctcgtggtcgcggtgaacaagatggatctggtgggtttccaagagagtgtcttcacgcaatttaaagacgattacctcagtttcgcggaacaattacccactgatctggacattaaatttgtcccgctctcggctctggatggcgacaacgtagcatcgcccagcgagaaaatggattggtattctggccccacgctgcttgaaatattagaaagtgttgatgtcgttaatgcccgccgtcagcagcccttgcgcttcccagtgcaatacgtcaaccggcccaatctggatttccgtggctatgccggtaccttgtcagcaggcgtggtgtgggttgggcaaaaagtgaaagtcttgccatccggtgtggaatctaccgttgcgcgcatcgtcacttttgatggtgacctgacggaagcgaatcctggtgaggccattacgctggttctggctgatgaagtggatatcagccgcggcgacttactggtggatgccagcgaaacgctgaaagcggcccggaacgcgttggttgatgtggtatggatggccgagcaaccgttggtcgtcgggcaaagttatgacatcaaagtggcgggtaaaaagacccgagcgcgggttgaaaacattcaatatcaggtggaaatcaattcactgacccaacgggtcgtggaaaatttaccgttgaatggtattggtctggttgaactggcattcgatgaacctttattactggataactatcagcgcaaccgtgataccggtggcatgatttttattgatcggctgagtaatgtcactgtcggtgcggggttggtccgtgaagcgctggcgtcggtttatcaggagaatcatgacttcagtacctttgagctggaattaaatgccttggttcgccgtcatttcccacattggggtgcgcgtgatctgctggggggtaaatagcgtgccagcccatcagttagatgaccataaccaagaaacgcggtcagacgatgagaatatcgtctggcacccccatgcgatcacccgacaggatcgcgaacaacagcacggtcatcagggcgtagttctttggtttaccggcctgtcgggttccgggaaatccactctggccggtgcgctggaacaagcgttgttcgctcgcggtgtcagtacttacttactggatggtgataacgtgcgccatggcctctgccgcgatttgggcttttctgacgctgatcgtcgtgaaaatatccggcgggttggcgaggtggctaaactgatggttgatgccggtctggtggtcttgacggcgtttatttcccctcatcgggctgaacggaaaatggtacaagatatgctggcatcgggtcagtttattgaggtatttgtcgatacgccgttagcaatttgtgaggcccgtgacccgaaaggcttatacaaaaaagcccgtgccggagagcttaaaaattttacagggatcgattcagtttatgaatcgcctgcgtctcctgatatccatttgcagggtgaacaattagtaacaaatttgattgaacaattgttagacgtactgcgtggtagagctattatcaaatcctaaacgtatccccttcgcacttgacgctacagggtcgttcgctgcaggtattcactcgaatcactgacgttgtcagctcgccgtgatttatttgcagcctacctgacgacaatgactttgggtacagatgcacttctgctacagggaaggcgtccttagaacgtgtcggtaaactgtgcctacaggggtttccatgcagaatgtcacccaaattatgaacgatgagcagcaagaagaggaagagccgtcttactccttctctggtggcgtcacaggttttgttttctactggttggcatttgcgatccctttctttgtctatggtcccaacaccgtctttttcctgctgtacacttggccgttctttctggcgttgatgcccgtttcggtactgataggtatcgcgttgggtatgctatcccgtggtcatctgctgtttactattggtgggacggggatcgccgtggtgtgcctcttctggatgctgttttcactgcttacgggttggtgaacgcttcatttacccgatgattcccctctcctgaaacacactctaaatatcccatattctcttcgcttttgaagctgcaggggggtggggggcttttactgacccaacttattgactgatctcagttcatcggccgcctggctgcaacgccaatgattttaggtatcgccccgataatgaataatgttttttatcgatttgcatggtatttttgcctgaaatcgtccttaatctgaatcttgtggcctatttccgtcacagagtggagtccgacgaaaagttgtgggatgattaggccgtttttcagggggcggaaatgggaaaacttacgctactattgctggttttgcttggttggctacaatattcattgtggctgggtaagaatggtattcatgattttgttcgggtaaaagaagacgtggctgctcaagaagcgaataacagcactctgaaagcccggaacgatcagctatttgctgagattgatgatttaaacggtggtcaagaggcgatcgaagaacgcgcacgtaacgaactgggcatgattaagcccggcgaaagtttctatcgtctggttcctgaccaatccagacgcaatgcgggtaccccttcgacacaaaataacgcgcaataaataatgagtaacttcgcagtttcccttcctgaagtgatcgctgtattaccggctgcaggtattggtagccgtatgttggcggattgccctaagcagtatttaactgtggggggcaaaacaatcattgaacatgctattttttctttgcttcaccacccacgaattcagcgggttatcgttgtgatccatccgcaggacacacaattctctaggttgtccgttgcgcaggatccacgtatcagtacagtttacggtggcgatcaacgggctaactccgtgatggcgggtttacaattggcagggcaggctgaatgggtgttagttcatgatgcggcacgcccctgtttgcaccttgatgatctcagccggctgttatcgattaccgaatgcagtcaggtggggggaattctggcggcccctgtgcgtgatacgatgaaacgtgccgagccgggtattcaagccatcgctcatacggtggatcgtcaggacctgtggcatgcgctgacgcctcaacttttcccgctagaattattaaaattgtgcttatcccgtgcgttaagagaaggggtggcggtgactgatgaggcctctgcattagagtattgcggttatcatccgatattggttaccggccgttctgataatattaaagtgacgcgcccagaagatctggcattggcggagttttatttaacccagcggcagtctctcaataacgacagtctctgaataatgacggtctctaaataacgatagccgctaaacagcgacaagtcagtgagatgggtaagcggaagtcgtgaacgttaatcaagactaacggcactgcaacgtcaaatagtcagaatattataaggaatgcatataatgcggatcggtcatggtttcgatgttcataaatttggcgagaatggcagtggtccactcattattggtggcgtgcgtatcccatatgaaaaggggttactggcccattctgacggcgatgttgcattacatgcggccactgatgcgctattaggcgctgctgcattaggtgatatcgggaaactcttccccgacactgacccggcatttaaaggcgcagatagccgaggtttactgcgagaagcgtatcgccgtattctggccaaaggctataaattggggaatctggatattaccattattgcccaggcacctaaaatggcaccgcatattccacaaatgcgcgttaatttagcagaagacctacaatgtcatatggatgacatcaacgtcaaagcgaccaccacggaacagcttggttttaccgggcgtggtgaaggtattgcgtgtgaagcggtggttttattagttaacgtagaacagggttaaggcataacgaatggatatggaaaacctgacctggctacacggtaaacctacggcgagcggtattttaaaagcgaatccggaagattttgttgtcgtagaggatttgggatttgaaccggatggggaaggtgagcatctgctggttcgtattcgtaaaaatggctgcaatacccaattcgttgctgattatttggcgcgctttgccaaacttcatccgcggttggtgagttatgcggggttaaaagaccgccatgcggtcaccgaacagtggttttgtttacacttgccaggaaaagaagcgccagatctggccacctttgagctggaagggtgtgaagtattggaagcggtgcggcataaaagaaaattacgcattggttcactgaaaggcaatgcgtttaccttagtactgcgccatattacggatcgccaggatgtggaacaacgtttacagcaaatagccgcccagggcgtacccaactattttggtagccagcggtttggccgtggtggtaataatctggtgcaggcccgtttatgggcgaataatgaaattcgggtaaaagaacgcagcaaacgtagcttttatctgtcggccagtcgcagcgcgatgttcaatctgattagcagtcaccgcttggcgcaacaactgtcgacgacggtactggagggtgatgcattacaattatccgggcgtgggagttggtttgttgctcaagcggatgaattagccacgttgcaacagcgcgttactgcgggtgaactgaatatcaccgcgcctttaccgggggacagtgaactgggtacccacggtgaggcattagcctttgaacaggcgtgtttggcagagcaaactgaattactgtcattgattaagcgtgagcgcgttgaaggtagccgccgggcagtactgctaaaaccgcagaatatgataagcaactggtgggatgatgtcactcttgagctgagtttctggctccctgcggggagctttgcgaccagtgtagtgagggaaataatgaaccaggatcgggctgatgatacggatattattgagtaacgatgatggcatctctgcgccagggatccagacgctggccagtgcattgcgggaatttgctcaggtgcaaattgtagcacccgatcgtaaccgcagtggcgcttccaatgcattgactctggatagtgcattgcggatcaccaccttatctaatggcgatattgcggtgcagcaagggactcccaccgattgcgtctatctgggcgtgaatgcgctgatgcgcccacggcctgacatcgttgtctctggcattaatgctggccctaatttaggggatgatgttatctattcgggtaccgtagcggcggcgatggaagggcgtcatttgggctacccagccttggctgtctcgctcaacggtcatcagcattatgatacggcggcggcagtgacttgccgtttattacgtgcgttacagcgcaaaccactacgtaccggcaagatcctcaatataaatgtgcctgatttgcctttatcggaaattaaagggattcgggtgacgcgttgtggtagccgccatccggcagagcaggtattttgtcagcaagatcccagagggcaagatctttattggatcgggccgccgggtgaaaagtatgatgctgggccagatactgactttgcggcggttgaacaaggttatgtatcgataacgccgcttcaagtcgatttaacagcttatacggcacaagaagtggttgaaagttggttagccaatactgaggttgacggggaatggtaaataaacgcatgcaaacattgttgatgcagttacgtcagcaaggtattcacgacgaacgcctgttacaggcgatcgaagcggtaccgcgtgagcgttttgtcgatgaagcgttggctcataaggcttatgagaataccgctctccctataggtgcgggtcaaacgatttctcagccttatatggtggcgcgaatgacagagttactgcaattgacgccaacgtccagagtcttagagatcggaacggggtcaggctaccagacggctattttggcgcatctggtcgatcatgtctgttcagtcgagcgaatcaaagggttacagtggcaggcaaaacgtcgcctaaaacagttggatctgcataatgtgtcgacccgccatggtgatggttggttaggctggcagtctcgtgggccgtttgatgccattattgtaaccgcagcaccgcctgaaattccggatgcattacttgagcaattggatgaagggggaatactggttcttcccgttggtgagcagttccaaacattaaagtacgtgcaacgtcgtaacaatgaataccatattgagacggtggaagctgtccgttttgttcctctggttaaaggggaacttgcctaaatgagtcttttctctttgagtctcttctatttcagccttcacctttagctaccgtgtaaaggtatttggacatatcgtttattattgctgtcatgggggaagcatgagcacaggaagcccaatgattagattacgccgagtcgcggcatgtacggttgtgagtttgtggttagtcggttgtaccaatgataattcaacatctgcacccatcagcagtgtggggggcgatcgttcagggacgatgttgagtggagcgaaaaccgatagctctggggggcgcatagtttataaccgcagttacgacaatatccccaaaggaagctacagtggtaatacctataccgttaagcgtggtgacacgctgttttatatcgcttggataacaggaaatgacttccgtgatttggcggcaaaaaataatattgcagaaccctatagcctgaatgtggggcaatctattcaattgggtaatgggtctggtggcggtatgttagccgccactgatgccacatcaggcggaatagcacaaccgccgtcaaatattcagaacacaactcctattcagaacacaactacaacggttgattctcaatcaactagcgcgtattctggaaactcgggtaaacagaatgttggcaaaatgttgccatcatctggtgcggttgtcgctacaacagcacctgttaccgcaccaagcagttctatcagtgaaccagccagcaatggtggtccagttagtggctggagatggccaaccgatggtaaaacgatcgatagcttctctgcttccgaagggggcaataaagggattgatatcgccggttctcgtgggcaacctatcctcgccacagcaagtggccgggttgtgtatgctgggaacgcactgcgtggttacggtaatctaatcatcatcaaacacaatgatgattacctgagcgcctacgctcataacgatacaatgctggtccgggaacaacaagaagtgaaggcgggtcaaaaaatagcaaccatgggtagcaccggaaccagttcagttagattgcattttgaaattcgttacaaggggaaatccgtaaacccgctgcgttaccttccgcagcgatagattgggcagaatacgctgtattctgctcgccggattcacgggtaggagcagcatatgagccaaagtacgctgaaagttaacgagttgcatgaagatgctgattttgatgagaacagtacggaaactgagatttttgatgaaaaagcattagtagatgatgaacctactgaaagcgagttagcagacgatgagttgttggcgcaaggtgttacccagcgtgtgctggatgcgacgcaactctatcttggtgaaatcggttattcgccactgctaacggccgaagaagaggtttattttgcccggcgtgcattgcgcggagacgtaccttcacgtcgacgtatgattgagagtaacttgcggctggtggtgaagatcgcccgccgttacagtaatcgcggtttagcgctgttggatctgatagaagagggtaacctcggtttgatccgtgcggtggaaaagtttgatcctgaacgcggtttccgtttttccacttacgcgacttggtggattcgccagacgattgaacgggcgattatgaaccaaacccgtaccatccgtttgcctatccatatcgttaaagagttaaacgtttatttacgtacagcacgagagctttctcataaattggatcatgaaccgagcgcggaagagattgcagagcaactcgacaagccggtcgatgacgtgagccgtatgttacgccttaacgaacgtatcacttctgttgatacgcctttaggcggcgactcagagaaagcgttgttggatattctgtctgacgaaaatgagaacggtccggaagatacaacacaagatgacgatatgaaacagagtatcgttaagtggttgtttgagttgaatgcaaaacagcgcgaagtgttggcccgtcgttttggtctgttaggatatgaagcggcaacattggaagatgttggccgagaaattggtttgacacgcgagcgtgtccgccagattcaggttgaaggcttacgccgtctgcgggaaatcctgcaaacgcaaggcctgagcatcgaggcgttgttccgcgaataagtgtgtcttcacaatgaaaggcggtgaacagtaagctttgtgcaaaatacaaagtaaacgtggccgatatgaagcacaaaaagagtcgatgaaacacaacaacggtgaacagatagataaatgttcaccgtttttttatgcccttggaaagatttttatgccttggcaaagagaatgggctgctcataaggagcctgtccataattctgtgtaactgccaccgtattaaaggtgatcgctcaggcggtcaccgaactcgataataaaacggctcatcgctaaccgccagttctggatcggcatactccatttttttgatgcatccttgatcgccaaataaacaaccttccgcactgagtcgtctgtcgggaacactttgcgctttttaatggctgcacggatcacgctgttcaccgattcgatggcattcgtggtgtagatagccttgcggatatcgggcggatagccgaagaatgtattgagattttcccagtgcgtacgccaacttttgctaatttgcgggtatttgtcgtcccaggcctccgcaaacttatccagcgccatcagcgccgcctcttctgtcggagcctgatacaccattttcaaaccgctggtgacggctttatagtccttccatgacacatatttcaggctgttgcgtaccatatggatgatgcacagctggatgtgagtctgcggataaacactgtttatcgcatccgggaaccccttcaggccatccacgcaggcaatcagaatgtcctgaagaccgcgatttttcagctctgtcagcacacttagccagaacttcgcaccttcattttctgccagccacatgcccagcagctctttctgaccttcagtgttgatgcccagcgctaggaacactgctttgtttatcacgctaccgttctggcggacttttacgacaatgcagtccatataaacaatgggatacagagcatccagttggcggttttgccattcagcaacctgctcttttacggcatcggtgactttagatatcagcgtgggagacacatcggcgtcatacatctctttgaaggtggcgacgatttcgcgggtggtcatgcctttggcgtacagggacaaaatctggctgtccatctgtgtgatacgcgtctgatttttctttatcagctgcggttcaaaggtgttttcgcggtcgcgtggcgtattcagctcgatttcgccgtcgtcgcatagcagtgttttggacgaatagccgttgcgggtattcgagcctgatttaggggtatttttctcgtgcccgaggtgttcggtaagctctgcatttaacgctgtttcgacggtaagctttgtcagcatacgagaaaatgcattaaggtcggcttcggttttaagacctttagccagttcagccgcaagtgctttaagtttcttttcgtccataatttgcctgtctccgttgttggagtgaagatatcaaaaacaggcaattacacaatattgtttacagtctcctcataagataccgccaatctctccctagaggcttgagccgcgacatcatggaacggacactttactccctgactccctgactccctgactccctgactccctgactccctgactccctgactccctgactccctgactccctgactccctgactccctgactccctgactccctgactccctcaccgcctaggatcgaatgaacagagacggaaacctgcggctaaaaatgatttcagccgcgagtttttagcttacaccatgttcttcaagcgatagatccactccagtgcctgacgcggtgacaatgaatccggatccagcgcttccagcgcttccacggcgggggggatctcttcatttaacagtgtcatttgtgagccatcaatcgtactggcggcggcgttattagagagtgattccagctctttcagtttttgtcgtgctcgcttaatgacatcgcgcggcacaccggccagtgcggctactgccaggccataacttttactggctgcgccctcttgtacactgtgcataaacgcgatggtttcgccgtgttccaatgcatcaagatgaacatttgctacaccttccattttttctggcaatgtcgttaattcaaagtaatgcgtcgcaaatagcgtcattgctttgatacggctggccagattttctgcacaagcccaggccaatgacaaaccatcataggtggatgtgccacggccaatctcatccatcaataccaggctttgttcggtggcgttatgcagaatattcgcggtctcggtcatttccaccataaaggtcgaacgaccagaggccagatcgtcagcggcaccgacgcgggtaaatatgcggtcaataggcccgatggttgcctgatccgcagggacatagcttcccaggtgtgccaagagcacaatcagcgccgtttggcgcatataggtacttttgccgcccatgttcggcccagtaatgatcaacatccgtcgctgaggagataacgtcaacgggttagaaataaagggttctttgaggacctgttccacaaccgggtgacggccacccataatcttaatccccggcttatcgctcagggttgggcaagagtagttgagtgtttcagctctttccgccagattagccagtacatctaattcagccagtgcattagcactgagttgtaattctggcagatgcggcagcagcaaatcgaaaatttcttcgtacaaccctttctcaattgccagtgccttaccttttgaggtcagaaccttatcttcgtactctttcagctccggaataatgtagcgctcggcatttttcagtgtttgccgacggacataatgaataggcaccagatggctctgaccacggctaacctgaatgtaatagccatgtacaccattaaagcccacttttagtgtgtccagccctaacttctcccgctcacggatttccaaccgatccagataatcggttgcaccatcggccagcgcccgccattcatctaactcagcgttataacctgatgcaataacgccgccatcgcggactaatactggtggcgtctcgacaatggcccgctccaataagtcttgcaattcgtcgaattggcccacctgtgataacaagttctgtacatgaggaacatcaataggttgcaataaacggtggatttctggcagttgctggaaagcatgacgcattctggccaaatcgcgtggacgcgcagttcgcagagctaagcgtgccaaaatacgttctaaatcgcccacttgtctcaagggggtttgtaactcggcggcgatatcttgtaggccaccaatggcttgttgccgatccgtgagcacgcgaatatcgcggattggcatatgtaaccagcgttttagcatccggctacccattggcgtcacgctgcaatcgaggatggctgccagcgtattttcactgccaccggataggttctgcgtcaattcgagattacgacgggtagcagcatccataatgatgccatcttgctggcgctccatggtcaggccacggatatgcggcagggatgtgcgttgggtatctttgacatattgcagcaggcagcccgccgcccgcagtgccagatgggcttgctcaacgccgaaaccaattaaatcacgggtcccgaattgcagattaagctgttgtttggcggtatccagctcaaactcccataaaggccggcggcgtaagccatgtcgatgctcgatcaacgacataggctcgaagttttccggatacagtaactcggcaggattggtgcgttgtaactcggcagccatcgtttcaagatcggcgggttctgcaacccggaagcggccagagctgatatccagagtggcatacccaaaccctttggcatcctgccagatagccgccagtaagttatcttgccgctcttgtagcagcgcttcatcgctgattgtgcccggtgtaacgatacggacaaccttccgttcaactggccctttgctggtggctggatcaccaatttgctcacagatggcggctgactcacctaattgcactagcttagccagatagttttctatcgaatgataggggacgcctgccatcggtatgggttcaccggctgaagcaccacgtttagtcagtgagatatccaacagttgtgaggctcgcttggcatcactatagaacagttcataaaaatcccccattcgatagaacaggagtatttcaggatgctgggcttttaaccgaagatactgctgcatcatcggggtgtgggagtcgagtttatcgttatttttcatgcggctattttttataatccattaaaatttaagttaattgtgatttttttgttggtatcgttagggatcacattgtctcactgaaaatgacgtgcaagtgcctgtggctatagcgtggtaacacggaataaacgtataaccagcactttgcgttgaaatggtgttcaactccgtaaattatacagttacccatgataatggcgcttatatgacaggcaaataggctggcaaacctgaatcatacaaagttatctaaatcatacaaagttatctaaatcatacaaagttatctaaatcatacaaagttatccgaatcatagaaaattatctaagccataccgtgttatcaaaatcatccagtgttatctcaatgataaagtccacggataaaacaaggcagatctggataagaatcatggcttgaggtgaccagtggtacgacacgtagtaaaatttttccatcgctatactagcctagccgctaataaactgacataggtaaaacctggaagcttctcgcaaactacgcttgcaatggcccggatgaaattgcaggagttaaagcaaatcagaaatgaagggcactgccccgcatctgagctgaaagatgagaagcaacggttattagaaaccgaaagcagcagtactgattgtagaggggttggttgaactgtacctgactgaacaatgattctgttgccaaattaggtacgcgcgttgcagcagaaatcccccgtaaagatatcgtcgctctggttaatggtgtgactgaacgtgacgcataggttcaggcagggatctcttgtgtgaactctcctctgcttttgagtttacggcacccctcaatcatgcaggctctgttcgtaatagcggatccgttccactttttccgttgatcctcctccgtcaaattcagcatctaaccaagcctcgatcagggttttggctaactccgggccaataacgcgagcgcctaaacagataatttgggcattgttgctttttctggctcgttgggcagaaaaagtatcatggcactgagctgcacggacgccaaaaactttattggcagagatgctcatcccaatacctgttccacaaataaggatcccgcgttcatgtttcccggctttaatcgccagagcaacctgaatggcaatatcggggtacatcgtcggttcttggtgttgatcgcagctgtaatcgacgacagtgatgttcttactttgtagaaaaataacaatctggtttttcatctcaatagcggcatcatcacagccgattgcaatagataacatattttacccctcaatagattgagctgtaatccggttaacccttcccacgcgtaaatatcatcaacacatctgtcttctttaggttttacatccgtgggttttgcataagggattgtataaaaccaagtctttcaaaagatcaccatgtgatcatttgttatatatattcaatctttttatatacccagtcaataaacttatgttcgatttttaattacttccgattttttcagctatttctgttgttttttaattggttgttgaggattggttgatgattggataagaaggatagattttatttatgactttcctcacagcctgagcattttttaatggtcgtaggcctgcgcttgatcatactgttcaatagtacgtagttaaatcttatgttcaatgcgtgtttaagatgaattcagatatctgacaagacatttatcacaaaacacgtgtgcgataaaaaaccgttaaaggagtccagcatgagtcacgaaaaccttaaaggcgctcaaatggcggagggtatccccgagaccatgcgtgcagttgtcgcctacgggccgcgcgattatcggtttgaaagagtgccggttccgactatcgatgccaaagagattttggtcaaagttgaagggtgtggcatctgcgccggggacaccaaggcttttgagggtgcccccagtttctggggtgatgataagcaacctgcttatatcaaagcaccgatgattccaggtcatgaatttattggtcacgtcgttggcttgggcgcagatgttgaggggtttgagctaggtgatagagtgacttctgagcaaattgttccttgctggggctgccggttctgtaaccatgggcagtactggatgtgtgaaaaacacgatctgtacggcttccagagcaatgttaatggcgcgatggctgaatacctgaaattcacgaaagaagcgattaattatcatgtccctgatcaccttcctttagaaaaagccattctgattgaaccctatgcctgcgcatttcacgcggtacaacgcgccaagataaaactcggtgatgtggtggttttggccggttcaggaaccttagggctaggcatgattggggcaattaaaaagtctggggctgccaagctcattgtgctggatttatcggatgatcgtttggctctcgccaagaagttcggcgctgatttggtgcttaatcccagtagagatgatgtgaataccctgattaaagaaatgaccggtggttatggttgcgatatctacattgatgccactggtgcgcaaaaagccgttgaacaaggattaaccctgctgcgtaagttggggacgtttgtggaattctcggtatttaaagatcccgtgaccgttgactggagcatcatcagtgaccgtaaggaacttgatgtcttgggttcacatctggggccatattgcttcccgctggtgattgaaggcatctctaacggtgatttaccgaccgagggggtcgtcacacatatcttgccattggagaaatatgccgagggtattgagctggtcaaaagaggcgttgactcacttaaagtggttctcaatcccaacctaacctaatcagtgcttatttcctgagtcagggtggatcacgaagaaggggtatgaataaggaatataaagatgccaaacgactataaatggtttgatacggcgttttctctgagtggcaaagtggcggccattaccggcggtgccacggggattggtcacgcgattgccgaactgtacttagccaaaggtgcacgagtggtgttgatggattgtgccgataatgtcgctgaaatagccgaacaactggacagggataatgccgtcggattgcattgcgatgtgagtgatagccaatccgtcagacaggcggtcgctcaggcaatcggggcttttggccagttggatattttagtgaatagcgccggtattgctgcgctggatcctgcggaaaaagtgcgtgaacaagattgggacagaacgattgatatcaacctgaaaggggtctttctcatgtgccaggaagtgggaaaacattttattcagcatgggcatggcaaaatcgtcaatttagcttctcaagcgggtgttgtggcgctccctaatcacttggcgtattgcgccagtaaatttggcgtgattggtatcaccaaagtactggcattagagtggggtccgttggacatacaggttaatgcgatttcaccgaccgtggtgctgaccgcgttaggccagaaagcgtggtcaggccaactcgctgaagatatgaagctgaaaatacccgctcgtcgttttgcttatcccgccgaagttgcagcgtgcgcactgttcttagccagtgatgcagccaatatgataaccggtgaaaatttagtcattgatggtgggtataccatccaatagtgctgtcgttgcgcgcgctaaattaccgcggcatccagttaactcactcactgtttttatttattttccattttaacgagattgctatgaatcgaattattaacgatccggatcaggttgtggaagaggcgataaaaggctatttagccgcttatccacatttttttgctaaaaccgcgcatgagaaagtattgaagtatccagagatacccctccaagggaaagtaggcgtagtgaccgggggcggttctggccatgaacccgcgtttctgggctatatcggtaaaaatatgctggatgccgtagcggttggtgagatcttctcctccccggcggctggggcatttttagaagcgtttaaagttgccgacggcggtgcgggtgttgcttgtctgtacggtaattacgccggggacaatatgaacgtcaaaatggcggcaaaaaaagccgaggccatggggataagggttcgcaccgtggttgctaatgatgatgtggcctctgcaccaccgtcggaaagagagaaacgccgaggtgtggcgggtgaaatttttatgtggaaagtgggcgcagcagcggcgtctcaaggctacgctctggataatgtcatagaggttgctcagaaagcgattgatcactgccgttcaatcggcgtgggcttaacctcctgtaccatcccggcggtgggtaaacctaatttctcgatagaagacggcatgatggaagtggggattggtcatcacggagaaccgggtattcgggttgagtcgctacagaatgcacatcagatggcgaagactatggtggatttggtggtcgctgataggccgtttagccaaggcgatgaggtagcggtgttgatctctgggctcggtgccacgccgaccattgagctgtatatctattatgcagaagtcgccaaattattagaggcgcaggggataacaatatatcgcccttatattggtaattattttacctcgctagacatgatgggggtcacgctgacgctgatgaaactggatgatgaattaaaatctttaattgatgtacccactcattcattaggcttaacccagttggagtaagggattatgaaggcattgttgataaccgatggatctataaaagataagtgcataaccgacggtaccccgatcattgaagagatggccaatacgatcctcgccaaccgtgaatacctgagtgaaattgacggtgctattggtgatggtgaccacggcattaatatggcgaaaggtttcaacctttgcgctgaaaatatcaaaggcaaaaatctgacgctcgctgaggcgctggatgcgctctctgacgcgctgatggaaggcatcgggggatcgatggggccactttatggcagcatttttatgggaatggccgagagtattcgtgggtgcgataaaatggatgcggtggcttttggtgcgatgttaaaaggtggcctggctgccttgcaagaggtgactgatgcccgtgtgggtgacaaatgcattatggatacgcttattccggcgagtgcggcatttgaattggcacaacaacagcaacagtcgtttgttgaatcgctacatcggatgaaacatgcggccagtatggggcgcgattccacccttgatctcgtggctaaaattgggcgggccagccgtctgggtgaacgttctcggggagttctggatgctggggcaacttcatgttgcttaatactgactcaactggcggattctgtagaacggcggttggtgccatagagagcggccagcagcagtactgaccgtggtattcaggtgaagaagcgatgtgggcactcagtcacgagactgccccaatcgctattggtctttttatctctcttttatctgtctgtaatattacgactgatgttgaatcatcttcaaaatagtccgggcattggatgcactggtcgcaagaatatcgatcgcaccggtacgcaaggcacccagcagcgctaatgctttggtgttttcagcggcgatagcgataacgcaggggatctggcgaagctcttgggtgctgataccaataacccgatcattcatcaccgtattcgcgggttggccttgcgcatcaaaaaaatcatatcccgcaatttcgcctgtcacaccttgatgcagactggcgtcgacgatctcctgaggagtgaaccagcccagctctaccatatagctgttttcgttcatatcaccgatgccaaccagagccatatcagccttacgggcgcggtccagagtctctttaatggtaccgttttgcataaaggcttcttttagcgcccggttttccacatacgcgggtgcgtacagggtttcactcgttccgccaaattttttggctaagcggcgactgatgtgatcggcattaatcgcatcacctgggcggtgtgttccaccgatgccacagataaacttacagtgcctttctggcacgacgctgacgtggtctgcgatagccgcaacattacgcccctggccaacggccaacaccgtgttgtcttttaagtttgtggctaagtaggctgaaaccaacgcggcgacctggcggcgttgttcatcctcatcttggtaatcaagggctatcagcgcccgtttcaacccaaaatgctcgattaactgttgctcaaggcgggtactgaataccggatgataacgaacgttaatctcaacgatgccctctgttttcgcgcgtttcagcaagcgaccgactttgatccttgaaatgccaaatttatgggcgatttcttcctgagtcatttcatcctgataatacgaaacagcaatttcagttaacaactcattgtcttgtgggatcatctgcttttccatagagagctgccctcggccacttatcacactcggaacgtatcacataaggtgaagggttattgttttaaacaggaatgaatagtagagcatttgtatagtagggtgaacagaaaaatttgccttttctgtgctgttggttttctctttttttcatggtagtaattactgttatttaaaatcagtaactggtctttaattttgttaaatttgtttttttattattaaattctgataatttttctttgcatgaaaaaacaaaagttcttatttcgttcttttgtattactatgacctattaataattcttcattgaatagggcgtagaccacgaataaatctgatggagtcagagggtgagctattttccccgcaatttatccatcttctttacacataggggagatccttcatcaaaatgccaggagagtaaccctactggcggcaatgctaataggcgcggatataaatagacgatgacagtaacagaccagtacatcgacaggcgattatattaacgggtgatgacattaatagatgatgacattaataggtgattacatcgatacggacaatcgtagtgcgagcgcgctcaacgtcaccaatagcactggaagggtcatgataatccctactcggaaataatatccccaagtgatggtcatatttttttgcgacaaaacatgcagccacaataaagtggccaggctacctataggggtgattttcggcccgagatcgctaccaataacattggcataaatcatcgcctctttaattaacccggttgccgtgctgccttcgatagaaagtgcccctaccagaacggtgggtaaattattcataatggaagagagaaacgcggttaagaagccagtccctaaagttgacgcccacagcccctgttcacccagtcggtttagcaacgctgaaatatagtgggtcagacccgcattacgcagaccataaaccaccagatacatccctaatgaaaaaataacaatttgccaaggtgcaccacgtagcacttttcccgtattgatggcatgtccttttttcgctacagccaacaaaatcagcgcaccgacggcggccaccaaactgactggaacaccgagcggttccagagcaaagaacccgatcagcagtagggcaaggaccaaccagccggttttgaacgtattcatatcgcggatagccgcttgcggggctttcagcagtgataaatcataaaccgccggaatgtctttacgaaaaaatagatgtagcatcgccagcgtggcgataacggcgaccagattgactggcaccatcaccgccgcgtattcagtgaacccgaggttaaagaagtcagcagaaactatattcaccaggttcgacacgataagcggcaagctggcagtatcggcaataaacccggctgccatcacaaaggctaatgttgcgccacggccgaaccccagcgccaatagcatggcaatgacaatcggcgtgaggatcagcgccgcgccatcattggcaaacagggcagcgactgccgcgccgagtaagatgatgtaagtaaacaggcggcgaccatggccattaccccaccgtgcgacatgtaaggctgcccattcaaagaaccccgactcatccaataacaggctgatgatgatgatggcgataaaagtcgccgtggcgttccagacaatttgccagaccacgggaatatcactcacatgtaccacgccagtgagtaatgccagtcctgcccccagcatggcactccaaccaatccctaaccctttgggttgccagataactaacacgatagtcaggataaaaatagcaccagccaacaacataacgcctccgctgagttaaatagtgtgtcgttccatccggtcatatatggagaaacagatataattaggtaaattttaaataggttagttacacaacattttgctgtcgggagtgacgttaccctgcgccagtaacgttatttcatcgcgttggctgagataagtttgctcgatgatggctgcggcccaagctggaatatggggcgacaggcggtagtggacccatttccctgcccggcgatccagtaacagcccggacgctcttagcatggctaaatgcctggaaatcttgggttgggcttcatttaagcgatggcaaagctcacaaacacacagttcgccggatgcttttagcaataagataatattcagacgtgtttcatccgataagttcttaaaaagttgcaacggcgtgagtgttgtcatgatgctccctgaatgaatttttctccgctatcttagtgttcaacgagagaatgtcaatttcatatttgttttttcaaatgtgtattgggcgcggggaggggataaccttttattgcgctgctggcagtattacgtttctaatagctaaaccgtgcaataagcccgtgccataaaatattagcgctatgggcttatgacgaagaaacacctacttggcggggctttttttttaggcgagagcgatatttatttttctgccggatgagcaatgaaccagcgtaatgagttcattactttggtttctgacatccttgctcttttctcatccacgagtttcattaatacaagccgagccgtgtagatatctagctgtgctttatcagcaacatctcttgtttttggccagttgtgaaccggaggaagagaaccaggaaattgtttttttagaacattacaatgatcttccaatatactcattacttcttctttccgttgattctttgctgtcattggtattgtcctcaattttactaatgttatttttccatggttattatcgggggtttcggttctaggtttatatattcgtacaattatgtaggtatattcatacagacgctttgaaatttcctacaatattttttaattaatccctcgtggtgtaagttaggtggttcatttctgtaattattgccttttgcgtagttaaacttctcttcattatttaagctgtaaagtcattaatttcatctcaatgaatttattttttatctttttaaaataatgagttaggctatgtagcctggtttctgctgatgtaggttttttgacacggttaacataggcaatcttggtggtttgctcatgtttcagtgatttattatcgttcagcttgggttgttttgcttttgcatgtatcaacatcaaaatcaggtgtgacagtataatttggttgtgagaatatgcaatctttaattttttataggtgtgttgaaatatacgggcagtactactgcactagtgatatatatcgagaatgtgatttcctccgattcaatttgtcgctatttttataattataaactattagtttaaaaaatatattctaaaacatttcatcatgagggtgaaataggtatggatacagtaatggaattttattttgagtattttctatactctattttatagggtttaattaagatgcgtcagattggctattatgtgtaaaggcatcacgtaacattgtatttttctgtttttttgtggtgactattgaagatgatatcgggcagaccgtttactaagcgaagagtgctgtaataaacggccatcgcctcttactggctactcagaaatattccacttttgtgctaataaggttttggtcttcccggccagccactggttaacttcttctaacaacggctgattatccttagccatcatataaactttgtagctgcccgttccggctaaaacctctggggtggcgacacaaaatacgccaggttctttgctctgataataatcgccttcgattaagtcagtgaacataatatctgcacttttatcacgtataccttgcaggttagcaacgttatctttggttcggatgatttgcgcttgcttaatatttgcatcaacaaacgattggttggtaccgccagggttgacaataactttgacgttttgacgatcaatcgcatcaagcgtggggaatttattgactttctggcaatgggtcagcgcaattttcccatttttcacgacggcgtgggataaagcaaattgcgcttctctgccgggcgttgctgtgacgccccccatggcaatatcaaatttatctgccgctaaatcttctgaaagagttggccaactggtcgaaacaaaattaaccttcaatttaaggtcttcaccaaaggcgtttgccatatcaacatcgtagccgatcaattggccctgtttatcatggaaagctaaaggcgcatagtcacctggtaccccaatacgcagctcaccactttgcttaatttcctgccaattttttgctaatacgtgttggctactaattaatgccaataccattattcccaaagataattttttcatctgcattcctgttattttttataagagcccattaaggtcaatcagggtaaattatcctactgtatattgctcaggaatgaggaatatattccccggtcaaactttccaggaaggccacgatatcgttgatatcctgttctggtagttgggtccctacctgatatttgagcattagctcaaccgcctgatgtaaatctttagcttgtgcatcgtgaaaataaggggctgttaaggcaatattacgcaagctcggtgttttaaagcggtgcatatcgcgtggatcgttggtgacgttgaaacgcccgaggtcatcggtagtttgctctttttggcgatcagcgaaatagtcactttttagccccaagaactcataggactgcccaccaatatttttaccgacgtggcaggtatcacatttattttgctggaatagcgccaagcctttttgctggctagtcgttaatgcctgtgtttcacctttcagatagtggtcgaaagggctgttgggggtggtcagggttttctcaaattcagcgattgcatcggtgatcgtgtcttcagaatagccttgcggatacacttgggcaaagtcctgggtcaactgtgggtcttgttgcaatttagcaattatatcttcccaagaggtcgaggccatttctactgggttaagtggtggtccaccggcttgttgctgcaaatcaacggcacggccatcccaaaactgctccacgttaaatacggcattaaataccgtaggcgcgttgatcccacctttttgtccatcgacacccgttgaggtcgccagattatcaacgcctcctttgttcaacagatggcaactggcacaggaaatagagttatcaccggataatctggggtcatggaacaggcgggaacctagtgccactttttggttgtcgaccagcaaggcatcggggatcggctgtagtgctaagtgctgcatttcgctgtggctattggaagggaagtatgtcgtccgttgtattttgacccaatcaaggatctggtttcgctcctcagcgttgatgctggaggaccaatgtaatgcgctaaagcgttgaggtggcatttgatcgcgagcaatagccgattctattttggctaaatctgcttcaggaacggcacgattttcttttaatgctaatagtgttggctccaatgagaaatgctggttaccttgtcgaatgtcatagtccatcagttgtttagggccggggatagcggcataaaatggcagggatgcattcgcggtatggcaataatcacaccctttttggtaaagaatattactgacctgctgattgggtgtttttgcctcgctgatgaaggtgttattacgtgtgttatctgtcatataaagatagccagcaatacccagataacctgcaattaccaatataccgccaccaattaatcctcttcttatcacagctgcactcctttgttgtgtggaaagtacctggtttgctctatggatagcatcagccgacgttcacgtttatttttctcagtctgccaataaccttatttatagagtggattatctctggaacgttgtctacgctggttgacctttatcaagctaatagggcggctttgcctattgctggaataggtattgcctatggatgagaaagtaagaagggatcaccaggaagggggcgattatgctttctgcttaatggtgttgaagaaaaatgatgctgaaggaattaatcgtactgaaggcgcgggggggataaaaaattcaattttatctgccgttggatgataacgagacatgaatatgaggccgtgatgaatttgtacatagattgatgtatttcgcaccacggttaataacgtctctgcattgatctgaacatgatgaatcgaattgcccgtctgaccacccgataatgccagcgtgtatgtcatcaatgggcaccctccatttggcttaattagtagccatgtatttatatgctccctttctttttcttaaacagtaatgataattgatatcatttgcttttacatttatgcgtatataattacaatagccttgaggtataaaaaacgaacataaatttgctagaggcgtataaaatgtcaaataaaacaatagcgttcgcgttagtagtggcatcatcagcccctgttatcgcagcagataatgacaatattatggttgttaccgcatcgggatatgaacagaagatcagagaggctgcggcaagcatctcggtcattagccaaaatgaattacgtcagcgcaattacaacgatttggcgcaagcgctgagtgatgttgaaggtgttgacgtcaatagcagcacggggaaaaccggggggctggatatcagtattcgtggtatgcccagcgcttataccctgatattggtggatgggatccggcaaaatggcacttccgatgtaacgccaaatggctttggtgccatgaataccagctttatgcccccgctatcggccattgagcgcatcgaagttatcaggggaccgatgtcaacgctctacggttctgatgctatcggtggtgttgttaatatcatcacaaaaaagatcaccaaagcgtgggccagctcagcaacgcttgaacacaccttccaggaaaatacggcttttggtgacagttcaaagttctctttttactccagtgggccagcggttgaagatcaactggggctgtcgttacgtggcacgattttccggcgcgatgcctctcgcgttgaatcctccaatacgggagtagaattaagccgtcgtggtcccaatccagtaaaagcagacaactataatctcggtggcaaactattttggcaattgaatacccaaagcaccttgtggttggatggtgatattgctaaccaaaaatatgataacagtgccaaccaactaggtaccattggtgcacgaggcggttacgaagatactctgcgttatcaacgccgtaaaataaccttgggcaacgataatcgtttggactttggtacctggaattcgagcttatcttataaccaaactgaaaatattggccgcttaatcaccaatgcatccgtgccccaaggctctgggttggcaggtgaaaaacgtctgttgaaaaataccaatatcatccttgatagcaagctggtcgccccgctgggtgataaccacatggtgacccttggcggtcaatattggaatgccatcatgaaagacggcatcgtactggcaaataatggcgatgagtttgcacaagatgcctggtcattattcagcgaagatgaatggcgtctgctggactcactggcattaacctatggcgcacgttatgaatatcaaactacgtttggcggtcatattagcccacgagcctatctggtgtgggacgcacaggataactggacggtgaaagggggtgtcagcacggggtataaaacccccactctagcccagttgcataatgggattagcggtgtcacaggccaaggcaccatcacgacgattggtaaccctaagcttgaaccagagagtagtgtcaacaccgaggtcggtgtctattatgaaaacgaaacgggatttggcgctaatgtgacgctgttccacaaccgcttcaggaacaaaatcaacagcgtttcgattgataataccaccagcacctacaccaacgtcggtaaagcgatcacgcagggtattgaggtcgcatccaccataccactctggtctgacgattggatgctgggaataaattacacctttaccgatagtgaacagaaagatggcaacaataaaggggctcgcctgacgaatacaccgaaaaatatggttaatgcccgcctgaactggaatatcaacgagcagttgtccacttggttgaaagcggagtatcgcagtaaaacggcacgttttacccaaaattacgcgaatttgtctgcggcaaacaaagtggtttacaacaatttaggctcagagtttaaaccttttagcgtacttaatttgggggtggcctataaggtcactaaggatgtgacactgaatggtgcagtcaataacctgttggataaagattttactcgcacccacatttttgctgtggggaacggcaccactactgcgggtgattacttcacctcgtctcaaagcactgccggttatgttgtacctggccgtaattactgggtatccgtgaatgttaatttctaggtattagcgttgtgagccatatcggtaaggcagaattctgacgaagaagtctattggaattggctgaacgaccaaaacatcggtttatcatgctgatctgaatagggttagtctttggtagctgatagtctttagtagctgatagtcattgataccgtaggtgcagccactatcagctaccacatttagcctctgttcaagaagaactaaccggccttttatccaaaggcgggctgaattggaattcatgatggcctcatttttacggtataaaaagccgcgctttgacgacataaaaaccaccaaaaccatattaactgtaatgttctactttattattctaatggcttagtttcattattttaccttataccgcttggcgtaaatgaacggcatggtatgtagattgctaacaaacaagactcttctataaggtaaaatatgcatattgatcactacagcttgcccgtttacgataaaaataatagtgataacaccctgaaagaaaccgaattatttaaagaagtcccttatttatctgctcggttaggggagcaggcttatgagtatagtggtggtgacatcagtaattatcatttatctattcaatatattatggacgttctggctgatcaggctaagggtaaagtggatttaagccatttttccagtgaggaaacgctctcttctcatgtttctcttgagaaaaatgagcataactatcattgctttaatcagcatgccagtactgtttatcatattaataataatgattttggccgcacgctggttgatctttttgagcagatgaacaattcgggtgaaaacgttcgagcattaaaaattgatagttctcaacattcaatggctgcgcgtctttatattaaagatacggagcaagggcagcgtttcgttgttaatttttatgaccctaatatcacggataaaactgtgcgttgtgaggtggatgacgcattaaaattgaatgactactcattaagaaatttcattagtaatcagacttacttatccagctatgttgatgcagagatatcatcaattattgtttgtgatcaagccgatatccatgatcaacataaggtgaaagagaaccgagcgttaacgccattatcacagagttcacctcttcctttatcggtagcacgattggatctgttgttaacagataattttgctgcaggcatacaaacaatggcagaagaagttaagaatctatcagagtccgagcgtaacacattctttaatcagctattacaaccgagggcggagaatgacctctctgggctgcaatgtgctttcaactatcagtgttttgatgcgttggaagcctactctgcattgttggtgcttgcaccaccagaacaacgaacagacttattaacaggaaaaagcgaaaatggctggagtagtctggctcaggccatgtcatctgggaatagtgatatggtgagcgtatgcttctatttgttgcaatggctccctttggacgatatgaatgcgtttgtgtggaagttgttagcatcccttcctttggaagatgcgaatacacttatgtgtccgttggaagaaccccttcctttggacaatatgagtacacgtgtggagtaatacactgatttcatgcaacagcaatctaattcattggtaaaagacgctgaaatatatgcacaacaatcagcagccgttacaccagcgtctgcttaagtggctcccgatgcacttaccttggtcggtgattcggtgattgagcagcgctaatacatctgcagaatggaggataacttcattctgcagacaacccccgatgacgcgatcttgaatggtgatgataggccgaagagtaaaacgtccgcgccagagatggcgcggcttgaatggcattcaggtgacaatattttttcaggtgacaatgtttggtcagatgaaaatgtttggtaacagccgatatcagatggcttcgtattcgccagtgccttcaggccagggcgtcagcaggtcgtatcccgattcggtaacggcaatggtgtgttcccactgtgccgaaagcgaacggtctttggtcacaaccgtccagccgtcagaaagtacgctggtcgccgcttttccggcattaatcatcggttcgatagtaaaaatcataccgggtttaagcagcatgcccgtttgggctataccatagtgcaaaacctgtggtgccgtatgatattcctgacccacaccgtggccacaatattctctcactacagaaaatcctgcgccctcagccaactgttgaatgcttgcaccgatgtcgccgagcgtcgcaccagggcggacggctttaatgccagccaccatggattgataggtaatatcgaccagacgtttggcccggactgagggttccccaacaaagtacattctgctggtatcgccataccaaccctctttgatgatcgccacatcgatattcacaatatcgccgttcttgagttttttatcggatgggatcccgtgacagaccacatgattgaccgaggtacacaccgttcgggtataaccgtgatagccaatgtttgcgggaataaccttcagttcgttaacgatataatcgtggcatagccgatcaatttcatcggtcgttatcccagcaagaacatagggttttatcatttcaagcactttcgcggcggcttgacctgccgcacgggccatttcaatctctgccggtgagtggattttgacttcggtcattgcgctttctctccattattcagcgtaagagcatcgggatagatcattttggcaatatccgctccgccttgcagttcaacctgcacaagtgcacgggccagttcatgatgactcaattgggggtaaagctcggccaacatgccaattttaagccagtgttccgcttgcgaattgatggagcggctcatggcatggctggcgatacgcagattctcatgcatcaaatcagatattttaacgatacccatacaacacctatacgaaacatatatgtatcgtatattgccataaataaggatcaaaatacagtgaacccactgaaacggaaaaggcctgagctccgtgaatgacggaactcaggccttgatagccgcttaatctaaattacctcaatatgttgaggccagtttatggcgtattaaatactcacctcagccacaacggttgcattttgccgcttggatctgctggaagaaatcattgcccttatcatcaactaaaataaaggctgggaagtcttccacttcaatcttccagatggcttccatccctaattcaggatattccacacattccagactcttaatactgttttgcgccaataccgctgccgggccaccgatgctgcccagatagaagcccccgtgtttatggcaggcgtcggtcacttgctggctacggttgcctttggctaacatgatcatgctacccccgtgggattgcagcagatccacgtaagagtccatgcgccctgcggtggttggcccgagtgatcctgaagcatagccttcgggggttttggccggtccggcgtaatagatcggatgatctttaatgtattgtggtaagccttcaccgttatccagccgctcttttaatttggcatgggcgatatcacggccaacaataatggtgccgcttaacgacaggcgggtggagaccgggtactgtgacagctcttttaaaatttcaggcatcgggcggttaagatcaattttaaccacttggccttcagtgctgtggcgcaaatgttcgggaatatatttccctggattctgttccagtttctccaaccaaatgcctttgcggttaattttgcctttgatattacggtcagcagaacaagatacccccatgccgaccgggcaggaggctccgtggcgtggcaggcgaacgacccgaacatcgtgggcaaagtatttgccgccaaattgcgcgcccagacctaaatcttgtgctgcttccagcaattcttgctctaacgcagtgtcacggaacgcttggccgtgttcattcccttcggtcggcaagccatcgtaatatttggtcgaggccagtttaaccgtcttcagcgtactttcggcagaggtaccgccgatgacaaaggcaatgtgataaggcgggcaagccgcggtacccaatgtgcgcattttctcgaccaaaaacgctttcagcctgcccggtgtgagcagggctttggtttcctgatacagataggttttattggctgaaccgccgcctttagtcacaaacaagaatttgtactcttcaccttcggtgctgtatagatcgatctgtgctggcaggttggtaccggtattcacttccttatacatatccagcgcggcgttttgtgaatagcgcaggttatcttcaataaaggtgttatagaccccacgtgataacgcttcggcatcgttacccccagtccagacccgctggccttttttgcccatgatgatcgcggtgccggtatcttgacaggtgggtaaaatccctttagccgaaatctcagagttacgtaggaattgcagggcgacatatttatcgttttcgctggcttccgggtcatccagaatggcggcaacttgtttttggtgagcggggcgcaggaggaaagaggcatcgtggaaagcctgttgagcgaggagggtcagggcttccggctcgactttcaggatgtcgtgtccttcaaactgtgcaactgagacatgtttatcactgacaaggtaatattcagtatcatcttccttgagcgggaagggatcctgatagtggaacggtttgtttgacatatttttctcacattcaacattcgttagcgaaaatgttcgttaacagaagtaatcatcagtaaaaagtcattattatcaaatctaatcatcatcaaaaataagcatcagcagagccaaagcgtacccagtcacgagtgttgctaacactgctgcggttacaaattagcagagttaagccaatattattattactatgactttgatcatgatcttactatagattgtcaggcttaagcgacggttccaccctctttataaagggtggatctcattttccgcacttatcgagggttcagccagtaggggagtggggcactgaccgacggtcatcgatctcaccgtgtgctggcctggtgacatgatggttttatcgatcactgaatgtgatgtatgaggcttacattaccgtgctgagcgcttcagcgacctgtttgaatttgtcaaaacgcgcccgtaatcgctgatttttttcagcattggggagcaggcgggtgatagggggcgggcaggcgcggatcgcctcttcaaacccgtggtaatagtggctccccaccgccgcacacagcgccgctgcccggcagccggattgctgaatatcgacaatttccagtggcaaattactggcatcgcagaacatctgcatccaaatagcggaatgtgtcgggccaccggtaaagcggatacagtcgatggtgtcatccaacgccaaaatcttgtcctgatgcagaagatgtgaaaaaaccactccctgataaatggcgtacacaatgtcttcgatattgtgatgcccacttaacccaagcaggcctccgctaagattagcactgtggttggagccgtatagccaagggaaaaacagaatatcttcagatttttcatagcccaaagccgcccactgattcagggtctggtagctatttggcagttcagggagaaattgtttcacgaaccaggcaaggttactggccgaggttgggctgccttcatgtacgaagtaggtgccggggatgcaatatttcccccaaacataggggtattcggagggggtgatcgcctcaaaaatacgggtggcgattgaccaagtacccgccaccgcactgagttggcggctgtcgtgtaaaccagaagtcagtgccgcaccgaccacatcaaacatgccgccgaacaccggtgttcctgctttcagcccacaggcgttagccgcatcttcactgacatgacctgctaaatcggctgaaccgataatcggcgcggttttctccatgacttcctcaatggcaaaaatcgccattagttgcggatcaaaactgccgttgtattgattataaagattgctgccagaaatattggtttcttcaatagtaaactcacccgttagacggtaacggatatagtcatggaccatgagcacataaccgctgcgctgatagttttctggctcgttttcctttaaccaacgcaagagggctgcgggatgggatggccacagttgttgcaggctacgttcataggcggcgtgatctttgccttcttgctgccaacggttaaccagtttctgtgcacgggaatcggaggaaacaattccgttacgtaccggcagcccctgtttatccaccagatataaccctttgccatgggcagagaaactgatgccaccgatgttctctgccgaaatatgatattccgataaagcacatgccttgttcagcgtttggcggatcacctgacaggtggcgatccacagggcctccatatcgcgctcacagaatcccgcttgtgggctaagtaccgggagtgcctgttcagtaacggcaatttcgctgccgtcggcggtataaataccggctttggtcacggtaccgcccagatcaatgccgagaaaatagtggctcatgtgtggctccttagcgggttaactggctggattcgttatcccagccagccaaccgcattttgtcttcgatccagtggcgggcatggataatttccagcaaaggctcagccgctttttctgtccacatctctatcaggaaggttccgcgatagttcaggcggcgcagggttttaaacagattaacgaaatcgacacagccttcaccaaacggcacatcacgaaattggccgggggagtcagcggtgacggcaaaggtatctttcagatggatcgctgcaatgcggtcaatcccttttgccaattcactgttgacttcattgccccaggccgtgaggttgccgatatcggggtagacggtaaaccacggagagccaatcttgttgtccagcgccttccacttactgatggagttcataaactgggtgtccatgatctcgaccgcacacatcacttgcgctgccgcggcttgcttcaccgcccaggcgatacccgcttcaaaacgtgcgatcgtttcactatcctgcggttcgtagtacacatcgtatcctgccagttgaatggtacgaatcccaagatcctgcgccagacggatagcctgtaacatgaccgtatgcgcttgctcccgcgtggcggcatcgcggctaccgaatggatagcggcggtgagccgagaggcacagggttggaatgcgcaccccggtctgttgaatggcactgatcaccgccatacgctcctcgcggctccaatccagacgagccagccgctcatcactctcatcaacggacatttcaacaaagtcgaagccgcaggattttgctaccgccagcttttcgacccaactggtgcccgcaggtagggctttttcgtatattcctagtgggtgaatgcgcattgtttttcctcttccccttcgtacttgacgttgcagcggtgttagctgcgctcactcacccgaatcacttactaatgtaagctcatcgggattcgttctcttgctgccttgctggaacgccaatgactttggggaacccttcgtacttgacgttgcagcggtgtttatctacataaacagttagctgcgctcactggaatcccaatcacttggcgtgacattttttagataattcaaacggttctgcctcatggcacgtttggctttccatttctctttaaaaaacttaaaggccagggcgaagatcagggtgataccccagaccgccagattaacgtgcaggctaacgccgagtaggctcagccccgtggcgatcacttgtaataccagcagagcgcagaacacatggctcactttacccacaccaccgaacgggttggttccgcccaagacgatagccaacacggtaagcaataaataagagtcgccgtagcccatacgcgcagagttgaagcgcgacatcatgatcaggcccgccagtacacacagcagactggacatggtgtagatagccatcatgacccggtcagtacgaataccgctgaaccacgtggcgttaatattgctgccgcacatataaatcgttttgcccaggcgcgttttacctaagaacagcgccagcagcagtgaggccacgatgaaaataatcatcgggatcggcacgcccatcaccacttcggaacccatactgcgaacaatcggtggcatgccactgagcgccgcgcctttggtcagataaacaccgatgccgctgataatggtcatactgcccaacgtcactaaaatgggatgtgcgccaatacgggcgatcatcaacccggtcagtgtgccgataaccacggcaatcagcgctgcccccatcagtgccagcagtagccacatcagttgtgtcgtggtactggcatctgcgggaacatattggataagcagccaggccataaacagactggtcaggtttgcggtaccaataatcgacaggtttaatccgccgctgagcatcggtacaaacatggcgaaggtcagtaaccccaactctggcaactgaaacgcaatactcagaaaggtgttctcggtaaagaaacggccaggcatcgccagactgaaggccagtgttgccagacaaaaaatccctaacaagccggaaatggtgccgtcgataggtagaaaacggttctttttcataaaacacccctgtcagacaaagccaacatcagtttctttgcgttttttgtagtgggttacgcaaatggcggcgacgatcaccatgccaatcacgatgttgacgaagtagctggagacaccgatcaggttgaggccatttttcaggatgccaatcaggaacacccccatcagcgtaccaatcacggaccctcgcccgccggataagctggctccccctaatactgctgcggccagcacatccaactcaccaccgaccagcgcgctaggtaccacttcgctcatgcggtaggtctgtaacatgccgccgatggccgccgccgcccccaaatagccataggcaaacagataaatcagagagacacggatcccgatacggcgagcggattctgggctgcctcccacggcatagagctgacggccaatatgcgttttattcagcaaaatccaggtcaacagcgcgatggctaacatgatgaccagcggcaagccaatctggtaactctcgccgttaacggtgaagggcaaaatagagcgctgatcgacccaccagttgggtaagtcataaatactgtggccgttggtcagccacatcagcataccgaacagcaaggactgcatactgatggtgataatgatcgaaacaatattcaggtagtaaatcagcacggcattaacgaacccgagcaacacgccgatagctaccgcaatgaccagacagagcaccgggctggcaatcacatcattaagcaacaaggaggcgaccacgtattgcaccacggaggccacggctgcaaaggagatatcaatccccccggtgaccagcaccacaaacaggccgagggcaaaaataccggtcaccgcgtagctttcggccaggtccagcacgttttgtattgagagaaactcgcggctgagcagagagaacagggccaacataagaacgatgacccaagccagccacccttcgacggattgcggtttgagtctgccgaaattagccattgatgacctccgccagctgttgttcagtcatttgattcgggatcagttcattgacgatacgcccctgctgcatatgcaggatgcgatcgcagttgtaataggcttcggggatttcatcagagagcagcaacaccgagatacccaccccggagagacgatggatcagcttgtaaatactgtctttggcaccgatatcgacccccacagtaggtgaatcgagaattaacactttcggtttggtcaggatccattttgccagcaccactttttgctgattgccccctgacaacgttgacagcgcgttatcagcatccgtgattttgatgtccaaatccttcacccattcttgcaccagcgcgttctgtttagcgtcatcaaccagataaagtggagtacggatgcgttgcagaatcgacagcaccatgttgtcggcgatagattgttgcaatacggcaccgagggtcaggcgatcttcagatacatagccaatacctagctcaatggcacgggtattgtctttaatgcgcaccgggttaccgtcaatggcaatcttgccgctatcaggatgggtgatgccaaataggctaagggccaattcggttcgcccggaacccagcaaaccacacaggccgagcacttcgccgcgatgcaggctaaacgagatatcgtcgaattgccctttacggcttaggttttccagttgcagcaccactttgcctaattcggcattgggtgatttctgctcgtgggtgagggtcaggccggtcatcaactcggtaatacgcccggtagaaagctcagtggctggccaggtccccactttttcgccatcgcggatcaccgtaatacgatccgaaatctctttcacttcatctaatcggtggctgacgaagaccacggtaatgtgcttatctcgcaggtaatttactgtgcgtaataattgattcacttcggtgcgcgtcaaagaggctgtaggctcatccataatcaccaagcgcgcatcggcaaccaacgcacggcagatagccacctgctggcgttgggcaatgggtaaatgttgtaccagcgcatcgggatcgagactaaaagccagttcatgcaagatctggcaggctttttgtttgattttctgcttgttgaaccagccgaagtaacctttcaagttatattcgaaggcaatattttcggctaccgtcaggttagggaacagcgaaaggtcttgataaatcacctgtacgcccaaagcgcgtgcgcgatcaggcgtcaggcggtgataagatttttcatcaatgataatttcactgccgtcatctggggcataaacgccactaatcgtcttaatcagcgtactttttccgcaaccattagccccggccagacagtgaacttcgcctttattcaacgtcaacgtgatatttttcagtgcctgatgaccgccaaagcttttggacagcgcttttaacgtgataagcggcacgtctctatcaacatcagaaatatgagtcatcgtgcagttccccggaaaacggccttaaaaccgcgggtcgaaataagggccgggcaggtgagtacccggcttatctccctcgctgattacgtctacctacaacgctaattatcttgggtaaaatcatcttttttagtttgcgcggtgcttataaaccgagcttcaccagacgtttggtattttcgatatccagcttttcagggttatcactgaggatggtattgccttgggttttgatttcgcccatatcacccagtttgacgccatctttgataggctcaccattcatcatggcggtagcggcctggacgaagactttacctgcgaccatggggttggagatgtaaccgccatcaatggcgcctttttccagcaacttaatgccctggcctggtgtgaaggtgccgaagacacaggtggtatcgttctttttacgcttatcaatagcccggccagccccaatagggccttgtgaaccaaaagacataatgcctttcagatctttatgtttagataacaaatcattggcagtacgcatggagtcatcgacagactcggcgacaccgaagcggtcttcaaccagcaccattttcgggtaattggctttttgataagcaatggcggcatctgcccactcattgaccagtggcacggtcaggctgccaacaaacatggcgtatttgccttcttcacccatacactgcgccatatctttcatatggttagcacctatgctctgggtatcgagcaattcaaaatcccagtcggcgttgatctgacccggtgactcgtgcgtgataaccttaataccggcttcttgcgcccgcttcagtacgggctccaacactttggcatcattaggaaccaccccgatgacatcgacttttttggcaattaagtcttcaatagcccgcacttgctcagcgggatctgcggtcgttggccccacctgccaagcgttaacccccaatgcctgaccttccgctttgataccttgctccattacattgaaccaaggaataccccccactttaaccacgacacccagggtaaacggcttattcgccttttgtggtgtgttgctgtcagcagaccacgccgcatgggaagccagcaaggtcgttattaagcaaggtaatattaactttctcatcattacatcctctgaaagcgcaataggtaaggccggctttataatattgatataaagcagattggcttgtttttgttgtatggctattttttggtgcaacggttctctggtgttaacgcggttaacttgatgatgccaataatccttaattaatttgcgtctatttatcggattcaataatatttaatttaggattatcgctgcgatagttttgtgagcttaatctattggtaataagaatatcgacttcatctaacgtacatattttacaaaatgcgtattgatcgaatttactggagtctgccaataatattttttgcccagacacttgcaacattacctgcttcaatttggcattaatatcattgccatctctaacgccactgtcttggttaatcccctgacaggagaagaaaaaggtattaatctggaaattcctgatggcattttctgccacggggccgtggaagtcatcgtgacgagctgagtattcaccgccaatcccaatgatgcgcactttgtcacggcaggctagcgcctgaataattttgaccgaattggtcactacggtaatttcaatatctggaatttgtcgtgctaaaaaccaacacgagctgctgttatccagtaaaatacaatcgccagggcggataaactgtaatgctgctttggcaattttcattttagtatcagggtgctcctccgttcgtttacggaaggactccgccctatcgatgacattgaggccatcgtgaatttctttaatatcaattaccggtatttcagggctatccagtgcgacagcgccgccaaaactgcggatcagtttttgttttttttgcaacaccgtcaggtcacggcgaatcgtctcctgcgatacctggcacagaaccgatagctcggtgaccagcgaggaaccttgttgttgtacatgagtgcaaataattttatggcgttcagcttgtaacatgcttacctcaacactctgtacttatcggattgtacttatcgggctggacttctctaaaaataagcacctgttaaattcatgctgctatattgatgctaatctgctgtttatacagtgactgaattcaaggattgctttaagcccctttttacccgccatttatgagattaaagtcactatttataatgtaattaatacgctatataactttaaaatgggttattaatcacataaaaaccccctctttattcattaactagtcacgcatggtaataaaaactcaaactcgggcattaaaataatgactaaatatgaccgaattagaccgattgggtttgtttggagcttttgttcctgtgggtgactttaatttaaccctaaatatcgttaggttagtttacggctacattttattggcgtcttaaattatggctagcgaaaataatagcctacataaatagtggtcatagaaagcaaatggtgatcagggaaaaaataatgatcatgggaaacaagccgtgatcgtagaaaagagtatctgccaataatcgccgccgttaatcacaggtgttagctaatagccatatttaaataaaggctattttttaaataaaggctattttttaagcaaaggcgattagttaaataacgtcattcgaataccgaatgatgtttttcattatcgcctgcccatctgaatactatttcatgaggtgcacgatgttagaacagttaaaacaacaggtctttgaggctaacttggcactccccaaatataagttggtgacattcacgtgggggaatgtcagcggcattgatcgcgaacatggattggtggtgattaagccctctggcgttgaatatgatgtcatgagcgtcaatgacatggtggtggtcgatttagcaaccggcaaggtcgtggaaggggataaaaaaccctcgtcggatacggatacccatctggtgttatatcgagctttcgctgagattggcggcattgttcatacgcactcacgtcatgccacgatttgggcgcaggcgggcaaatcattatctgcattgggaaccacccacgcggactatttttacgggccgatcccttgcacccgcttgatgaccgaggcagaaattaccggtgattatgagcatgagaccggtaaggtgattgtggagactttcgctgaacaggggctgcgagcggcagacattccggccgtcttggtcaatggtcacggccccttcgcgtgggggagcaatgcggctaatgcagtacacaatgccgtggtgttagaagagatagcctatatgaatctgtttactcatcagctaacgcccggcgtaggagatatgcagcagacgttgttggataagcattatttgcgtaagcatggggctgcggcgtattacggccaataaatccccttcgtccttgacgctacagcgttgttagctgcgttcacttacccgaatcacttaacggtcgttgattttaaaattaatagactcatcgggatgcgttctcttgctgcctagctgtagcgccaatgacgttggggattcttttcggtcttcgagattacagcgttgttagtggcgttcattcatcacaaaagcggcaaatgggcacccactctcagcgctttattgattccagacaaactcccccctcctcgaaagaggtaaagtccgtcgtagcaggaagacaaatttattatcctacttataaaaaaaccctttaatcgggccattgcgctctcactgaagcccccaatctcctgctgatctgctcattttttttgaattattcgggcgccatccgcactgggtgactctcattttctggaatgcaactaagtgggaatcttatgaaagagaccaacgaatcccggctgttaacgacaggtgtcacccgccgaaaactggtccaaaccacgcttgtcggcggactggctatggcaaccggggcgttttcgttaccgttctcccgtaccgcacgagccgttcaatccgcactcaaccccacctcagccaacgacggtaaagtgatctggagcgcctgcaccgttaactgcggcagccgctgtccgctgcgtatgcatgtggctgagggcgaaataaaatatgtcgaaacggataacaccggcgatgatgattttgaggggctacaccaggtacgcgcctgtctgcgagggcggtctatgcgccgacgggtctataacccagaccgcttaaaatacccgatgaaacgaatcggtgcccgtggtgaagggaaattcaaacgtatctcgtgggaagaggcattcgagactatcgctggcagcatgcagaatattatcaaggaatatggcaatgaagccatttacctgaattacggtaccggcacgataggcggcaccatgacccgctcttggccgccgggcgcgacgctcttggctcgcttgatgaattgctgcggtggctacctcaaccagtatggtgattacagtaccgcacagattgccgcgggactcaattatacctacggtggctgggctgacggtaacagcccgtccgatatcgaaaacagtaagctggtggtgttgttcggtaataacccggctgaaacccggatgagtggcggtggggtcacctattatctggagcaggcacgagagaaatccaatgccaaaatgatcgtgattgacccccgttataccgacactgccgcaggccgtgaagatgaatggatcccactacgaccaggcactgatgccgcattggcctctgcgttagcttatgtgatgatcactgaaaatctggtggatcaacccttccttgaccaatattgcgttggttatgacgagaagacgctaccagaaggcgcacccgaaaatagtcactacaaagcctatattttagggcagggcgcagataaaaccgccaaaaccccacaatgggcagcggctatcaccggtattcccgccgcaaaaatcattacgctaggccgtgaaatagggtcagtgaagccggcttatatttcccaaggttgggggccacaacgccattccaacggcgaaaacaccagccgagccattgccatgttggcaatcttgaccggtaatgtcggtattaatggcggtaactccggtgctcgtgaaggctcctacagcctgccgtttgtccgtatgcctacctttgaaaacccagtcaaaaccagtatctctatgttcttgtggaccgatgccattgagcgtggacctgaaatgaccgccacccgtgatggggttcaggggaaagataagctggatgtcccgatcaaatttatttggaactacgccagtaactgtttggtgaatcaacattctgaaatcaatcgcacccatgacattctgcaagacgataagaaatgcgaaatgattgtggtcattgataaccacatgacctcgtcggctgaatacgctgatattatcctgccagactgtaccgcctccgagcagatggacttctgtctggatgcctccagcggcaatatggcctatgtcatttttgctgatcaggtgattaaaccgcgttttgagtgcaaaaatatttatgacatcaccagtggattggcaagacacatgggggtcgagcagaagtttaccgaagggcgaacgcaagaagagtggatgcgccacctctaccagcaatcgcaagccgcaatccctgaactgccttctttcgaggatttccgcgctcagggcatgtttaaaaaacgtgacccggcaggccatcacgttgcctatcacgatttccgcaccgatccggttgctaacccactgagtaccccatcaggcaaaattgagatctattctgcggcgctggccgagattgccgcgacttgggaactgcaaaaagatgatgttatcgatccgttgcccgtgtatgccgccggttttgaaagccatgttgatccactgatcgaacagtatccgttgcaattaaccggcttccactacaaggccagaactcactccacctacggtaacgtagatgtgttgaaagcctcctgtcttcaggagatgtggattaacccgatggatgccgaacggcgagggatcagcaatggcgatatggtgcggatcttcaatggccgtggtgaagtacagattaatgccaaagtcactccgcgcatgatgccgggggttgtcgctttgggtgagggggcgtggtacagccccgatgcgaagcgtattgatcgggcgggcagtatcaacgtattgaccacccagcgcccctccccgttggcgaaagggaacccatcccacaccaacctcgttcaagtcgccaaggcataaggagctgactgatgacaacgcaatatggtttttacatcgactccagccgttgtacagggtgtaaaacgtgcgagttggcctgcaaagactttaaaaatctctcaccggatgtcagctttagacgtatttacgaatacgctggcggtgattggcagcaggataacgggacatggcaccagaatgtgttcgcttactacctgtctatcgcctgtaaccactgtagtgaccccgcctgtactaaggtgtgtccgagtggtgctatgcataagcgtaatgatggttttgtggtggttaacgaagatatctgcatcggttgccgctactgccatatggcctgcccttacggtgcgccgcaatatgatgctgaaaaagggcacatgaccaagtgcgacggttgttacgaacgggtggcggtagggaagaaacctatctgtgtcgattcctgtccactgcgtgcattggatatggcccctatcgatgaattacgcgaaaaatacggtgatttagctgaaattgcgcctctgcctgccgctcacttcacgctgccgaatatcgtactaaaacctaatgccaacagccgcccggtcagagataccaccggtcatctggcaaacccgaaggaggtataacatgggctcaggatggcatgaatggccactaatggtctttaccgtactggggcagtgtgtggtcgggggctttattgttctcggtctggcactgatattcggtggtttgagtcgcgggcaacaacagcgggttcaccgcagcatgtttgtgctttgggtgctgatggcactggcttttatcgcctctacactgcatttaggttcgccaatgcgggcgttcaactcattgaatcggatcggtgaatctgcactgagtaatgagattgccgccggttcgttgttctttgctgtggccggtttttactggttgttggcggtgttggataaaatgcctgccgcgcttggcaagatctggctggtggtggcaatggtgctgggcgtgatgtttgtctacgccatgtgccgggtctactccattaatacggtaccgacgtgggacagtatttataccccgctgggctttgtcctgaccacgttgatcggtggcccgctattgggttatctgttgctgcaattggctgatgttaatgggcgggcgatgttacaactgccgatgatcagcgtattggcactgatcatcagtgtggccagtgtcattatgcaggcggccagtttgccgctgatttatagctcggtacagcaagcttcagcgctgatccccgactatggctcattgatggtatggcggttagtgctgctggtgttggggcttggctgctggatttgcccgttgatcagaggccgtcgcccgatgacgctggtgatggtcttgggcacgttactggttattgccggtgagttgattggccgtggggtgttctacgggttacatatgacggtcggtatggcggttgggggctaatctccagacggcgacgacactttggctattctggggagcgcccagaatagctttgctctgcctcatggcgtgctaaaaccaaggtcatacagggctgaacaacatgatcataccaacatgatcataacaatatggtcgtaagaaaatgattaaaacagatatgacttatcaagacattgtttataaagatactgtttatcaagacagtgtttatcaaaaaatcggactaacggggcgagtgctaggtgcgcttttttattgtgagccggatagcgcggagtgccgcgatattgtggtgcaattgcgtaatggcacgtgggccgctgaatggccttatggtggtgccgacgaactaatgccgattgcgacattattggcggcagctcaatcagatcagtatcaatccattgctcatcaatcagcggcagccccattagcagaaacattggaagaggcttggcagcggctgtttattggtccgtatgccttgccagcgccgccttggggctccgtttatctggataaagacatggtgctgtttggcgactccacactaaaactgcgtaactggatgcagcagcggcatgttgaagtcacattgaaacagcaggagcctgaagatcatttcggtttattgatgatgatggcggcctggttggcagaacatcagccggtcgatctcccggttttgttagctgatcacttattaccctggagttatcgttatctggcgttgttgcaatccgatgcaggccacccgttttatcaagggttggcacagttggccaccctgaccttgacccattggcaacatgaattgcaggtgacaccggctagggttgagttatatcgctaaatctgaacttatttatttaaatctgaacttatttatgtgataacccgcgtgactttttaccgatattaccggtcaggctaatcagtgaatcaagggggagccggtttttttgattggcatcttcagaaacgccaaggcgtgatacgggtaatcatgtggctgcgcccgctggctgtattctttaactggttgcattctttaaaatgtcccgcaaacgcggggcaaagagaaacggaacaatttaacctctcttcttcttaacctctcttcttcggcatcatgcgcaagagagtattatctttcaaaacgtaatgatgcagtaaggccgcaagagcatgaaggccaataacaaaatagctcatattggccagcaataggtgatacgcctttaatgtatccgccagatcaaaattcgcctgctcggcatggggcatgatcagaccaaaggctatccacgagcttccgcgacagtaaagtatggcgataccgatgataggcaacgcgataaacagtaagtagataacccaatgccctacatgcgccaaccctactatcataggactaggcttcggtactattggtggtgtcgggtacctcagtcgtatcaatatccttgtcatcatcaacaccaggatggcgatcccacaggaaaagtggatcatcttcatccagggctgatagctacgaggtgcaaacccgcgcaactccatggagctccaggcgataatgaccagtaataggactagccaatgaatacctatttgcaggcaggaatacttcttgtgcatatgctttcctgaaatatacccgtcgcccttcacgatgcaggggttagctgcctacctgcatcttgaagtcacttgggtatataattattttatataaatacctgtctggagatatattcaatactcctctataaattaataaaattttaacgatatctactatgataggtattacgaatgttgattatttccccaaccgatttttttacctcctgaatatttccttcttccgcccattttttggttttgtctatttgttctattagtagatcaaaaccatgccgatagtcttttatttccggactgtcctcggctttcccttcaagcttgggtggaatggctttttgagcatcaagggcggcattacgcattttttccagtgatgaggtaatgacctttgtatcggttgatgaacttacaatgcccaaattggctatcagaatattcatatcatcctgaaggctcgcggcaaaagtacaacttgtgatgagtaatgagaaaacgcccgcaattattggaatttttcgcattatcgttacctcttatattatgattttcttctcttataaatagaggggggaagataaatcctcccctctatttagttagttattttttatatcaaagcgatcaaggttcatgactttttcccatactttagtaaagtcatgaacaaatttttctttggcatcatcagaggcataaacttccgcaaccgctctgagttcagggtttgaaccaaagactaaatctacagaacttgctgtccatttaagtttccctgttttccgatcatacccatcgaaatatccttcagctttaggtgatttagtccatttggttgacatatcaagcaggttaacaaaaaagttgttattaagctgccctggcgtattcgtcaacacaccagccttagaccctcccgagttaacatccagtacacgaagtccaccaatcagtactgtcatttcaggcacggtcagttccagtttattcgcccgatcaatcaacgacgcgataggcgaaagcgtgtttcttttcgcatcgtagtaattacggaatccatcggctgtgggttccagtaccgcgaaagaactgacatcggtttcttcctgagaagcatctgtccgacccggtgtaaatggaatactgatactgtatcccgcttttttagctgcatcctcaatggctgcatttccgcccagaacaatcaggtccgatagggatacttttttaccatcgcttctgtctttattgaaattgttctgaacctccatgagtgccgccagtacactgtgtagctctgcgggatcgttgactggccagtctttttgtggtgccagacgaattcgggcgccgttatcaccgccacggaaatcggtaccacggaatgtggatgctgaagcccaagcggtcttaatcagttttgtatcagataaacctgtcttcaatattttatctttcagttcagaaatatccgcactgtcaatcatcttataattggcagcaggcagcgggtcttgccagataaatgtttctttaggtacctcatcccccagataacgcgctgcgggccccatatcacggtgtgtcagtttgaaccacgcgcgggcaaatgccatcttgaattcttcagggttttccaggaaacgtgttgttattttcttgtattcaggatcaacttttagggcaatatccgttgtgaacatcatcaaaggatggaacttagttggatcggttgcatctggaacgacattggctgcatttttaggcttccattgccaggccccagctgggctcttggtcaatacccactcatgtttgtataaattactcaggtattgcatcgtaaaatgcgtaggatcggttgtccatgccccttccaacccactggttatcgtgtccttaccattacctgaaccacatttattcgcccatcctaaaccttgttgttctagccccgcttcacccggtgctgcacccaggcatttttcaggagacgctgcgccatgcgctttaccgaaggtatgccctcccgcaatcaatgccacggtctcctcatcattcattgccatcctggcaaacgcttcacgaatatcttttgccgcagcaaccgggtctggtttaccattgggtccttcagggtttacgtaaatcaaccccatttgtgtcgccgccagcggcttgggtagcttgccatttttatccctgttatcagacagcatcttgttgcctgccccccagtagaccagatcggattgccaatcatcctcacggcctcctgcaaaccccagcgttttaaatcccatagattcgagcgcgacattgcctgtaaggaccatcaggtcgccccacgatattttagcgccatatttcttttttataggccacagaagccgacgcgctttatcaaggttggcgttatctggccagctattgagtggctcaaatctttgctgcccgccatcggcaccaccacggccatcatatatacggtaggttcccgcaccatgccatgccatacgaataaagaatggaccataattaccataatcagcaggccaccagtcttgtgatgtggtaagaactgtttttatatctttctttactgcttcaagatccagtgttttaaactgttgagcataattaaaatcctttccgtaaggattggactctatattatgtaaacggagtggagagagatcgaggcttttgggtaagtaaaaactatcagtcttgggtgcttctgctgcccaagccgtaggtgtattatgtacaatggcgagagttattagtacgggtaagattttttttaacatatataagtcccctttaactaaaaggcaactattttttaacatggttaaattggaaaatacaattcgttagtcctattaatatgatagattctatctattattgataagagatatataggattgatggcctgcgaatattgcgttaaataatggttccatgggcagtttctaagagggaataaccacgtctgacaatgatgctgatcgaatcgcgagaatagaagaagataggtttctataaataacgctgtgtcactgccgctatattaattcaaggtgttcgctcatacggcacgaagataaaatgccccttacccactgcccattctggatcggcaggctttctttttcgctccacccccgcgagtcactgtaaaagtgcgtttgtttctgagacatcccctctcccttatcgactaatttgtgaccgacttctactttccttgctctgacattggacaaggcgtagggcgtttgtattattagattgaatataaatttaatggtgaatatatattcaatgcggagaaaaataatgaaaaataccctactgaaatcctgtcttaccgcagcattaatctcaatggcaggcgttgctggtgcggccagcaatggtctgatcgccatcatcaccccctcccacgataatccgttctttaaagcagaggctgaaggtgccaaagcgaaagcgacggaactgggatacaccacactggttgcttcgcatgatgacgatgtgaacaaacagaaccaactcattgagaccgctatcgcccgtaaagccaaagcgatcattctggataacgccggctctgacgcgaccatcggcccattgaaaaaagccaaagccgcgggtatcccggccttccttattgaccgtgaaatcaatgaaaccgggattgccgtctctcagattgtctctaacaactatcagggcgcgcagctgggcgcggagaagtttgtcactctgatggggggcaaaggtaaatatattgaattactggggcgcgagtctgacaccaacgctcatgtacgttcgcagggttatcacgacgtcattgacgaacatagcgacatgaagatggttgctcaacagacagcaaactggagccagactgaagcattcagccgtatggaatccattttgcaggctaacccagatattacaggggtcatttccggtaacgacacgatggcattaggggccgaagccgcattaaaagcggcgggccgcaatgatgtggtggtggtggggtttgatggcagtgactatgtccgcgactcaatcattaacaacggcaatatcaaagccaccgtattgcagccgggttgggcgcaagcacaaatggccgttgtccaggccgatcagtatctgaaaaccggtaaaaccggtctggaagagaaacaactgatggactgtgtattgattgacgaaaataacgctaagaacctgaatgtctttgcgctgaaagactagccgctacaggcatgttcgctaaagccagtgcgataaaacatccgctttagccgtaatgaggggcgacatcgcccctcctttcaggaggcattatgaggttccgtgcgatatcgaaagcaggcgctttgctgatgatcagtgctgtactggtggcgtgcaccgtcgtggatttggatgaaaatggcaaaccgatcctgccggtcgatccgaacgcggtggtcagtgactataaccagacgccagataaagtggcggccaccatttgggcgaaaaatgtcatgccatttgccaacagcaacgccatcagttggcaagaggtgaaacaacagcaaagccagcctgcggtcgggaaaaataaccaaagccgctttgtccgctttaccggcaaggtcgtggcagtagaaaccgaaggacgggaagggctgattcgtttggctatcgacggtgatgaacaggtcttgcaattggggccaattgtcaaaggtaatgctattcgcgatgcctccacctttatccgctttgacgattttaaaaaccaggtgcaatacgcccaacttgccaaggcattaagtctgcgtgcgttgcaggaggtggccaaacctgatgccagttggattgggcagcaggttgaggtactggcggcagtcacattgacaccaaccagcctgagcaatggtgtgccactgagtttgaataaggagagccactgatgaaccacagacctgacattgtcatgcgtgctgaggacatttcaatgcgttttcctggcacattggcgctcgatagcgtcaattacactgtttatcgcggcaaagttaacgtcattattggcgaaaacggggccggtaaatcaacgctgatgaaaattctggccggggtgcagcagcaaacctccgggcaaatttacctaaacgggcagaaggtcagcattgccaatactcgtgaggcggcagcgctgggcattggcatggtgcatcaggaactgaatttatcggaaaacctcaatgtggcggaaaatatttttcttggccgcgaaatccagcacggcttgaaaccgatcaatcaggcagcgcaggaacgggttactgaacaactgatggtgcgtcttgatcaggtcatttcaccgcaagagaaggtgtcaaacctgaaagtgggccaacaacagttgattgaaattgccaaggcactggcggagcaggccgatatcctgattctggatgaaccgacctcggccctcagtaaaacggaggtggatatcctgttccgtgtgatccgcgaactcactcggcaaggggtttccatcgtttatatttcccaccgattggaagagttaatggcgattggcgactacatcactattttacgcgatgggcgctttcaggctgaagccgcagtaaaagacattgatgtgccgtggattgtgcgtgaaatgctgggtagcgatccggtttccagcttccttcgtccggggcgtacctttggtgaaccaatgatggaggtggaagatgtcaccctcatcaatgaatccggtaataccgtggttaatcatgtctcattgcacgtccgggcaggcgagattgtcggtatttatggcctgatgggggcgggccgtaccgaattgttcgaatgtttactgggcacgcaacaaaactatcttggcaccgttcgcctcaatggcacggtcatgaatgccaaaacctccaccgcagagcgtatccgccttgggatgagcttggtgccggaagatcgtaaaaaagccgggattttccctgcttcatcggtcgcctgtaatttgaccatctccagcttatggcgtcggctgaagcaccgctttgctatctggcaggagagtgaagtgcaagtggtggcagcgactatcggtgagctgtcgatcaaagtttcttcacctgatgtcgaaattcaggcactcagcgggggcaatcaacaaaaagtggtcattggccgctcgttactgacccgcccgaacattttgctgctggatgaaccgacgcgtggcattgatgttggcgcaaaagcggatgtgtttgaaatgatggtgaaactctctgagcaggggatcggcattctgttttccacctccgacctaaaagaaattatggcggtatccgaccgcattctggtgatgtcgaacggcaaactgacggcaaatttatcccgtcaatcggccagtgaatcggcattggttacagcaagcgcacaagggtttgaatgatgaaagcaacaactggcacggcgttggcgagtcacctgcccggtggagcgtcatggtcacgggaaaatatgctgctgcttctgttaaagatgcgcacctttattgccctgtttctgatcctgggtttcttttcaatcatggtccctgggttcttagccacggggagtttgatcatcatggtgaagcatattgcgattaatgccttcctcgcattaggcatcacctttgtcattatcaccgcaggtatcgatctctccatcggcgcgacgctggggctgtgcggcatgattgccggttggatgatcacccaaggcattgtcttgccgatgtttggcatcgctatcttccccagtgtttgggttgtggttccggtggtgttagttatcggggcactcattggtgcggttaatggctggatcattactcgctacaacgtcgccccgtttatttgcacccttggcaccatgtatgtggtgcgaggggcctcgatgttgatctctggtggcgaaaccttccccggcttacaaggcaatccgcaactggggaataccggttttgacctgctgggatcgggaacgctactggggttgccgatcgccatctggattatgttcattctggcgctggtgattgcttacgttgcccgccgccttccgtttggccgccatgtttatgccatcggggataacgaacgcgctgctgaactttctggtgtcaaagtgcgtcaggtgaaagtctgggtttacaccctatccggcttctgtgccgcgatagcggggattatcgtgtctgcccaattggttgccagccacccggccaatggcagtggcttcgaaatgaatgctatcgccgctgttgttctgggcgggacatcgctggcaggcgggcgggggaccattcttggtacgctgattggcgcttttgttatcggcatcttggctgatgggctggtgatgatgggcatcagtgaattctggcaaatggtgatcaaaggcatcgtgattatcgtggccgtgattatcgatcagatgcaaaaccggatgcagcacaaggcggcgattgtgtcgcaaaaagtgaccgccatcccctctgacatcacctctcaggcggtaaaaagtgagtagcggctaaagggctgagcggatcgaagtgagctgaactgaggtgaactgaactgaatcacaggccactgcatacggcagtttgagtgtggtgagccacaacgcactgaagacgttatgccggaggggggatctccggacaggcttgatgaaagctatttttttagtctcatcgagaataaatattcggtaatgagtaaaaattcaagagaggtaatgtcatgaatccgtattcactgtcaatcgatgagctggtgagaaaggcgcgggcgatccgccgccgtatcgtcctgcttaatgcgaacagccccgcaggtgggcataccggtgctgatctttcgcaggtagagattctgacggcactctattttcgtatcctcaattgtgcgccggagaggcttacggatccggagcgcgatatctatgtgcaatctaaaggccatgcggttggcggctattattgctgtttggccgaagcccgttatttcccggaagagtggttggcgacttatcaacgtgccgactctcatctgccaggccaccctgtaaaacacaaaacgccaggcattgaactcaataccggggctttagggcacggtttaccggtggcggttggtatcgcactggcggcaaaacgagccaacagcaaacgtcgggtctttgtcctgacaggtgatggcgaactggccgaaggcagcaactgggaagcagcgttagtggctgctcactatcaattagacaatctggtgatcatcaacgacaaaaataaactgcaactggcagggaccactaaatcaattatgaataccgatccgctggcagataaatggcgggcgtttggtctacaagtcactgaatgccgtgggaatgacatgcaatcggtggtggaaacactggagaccctaccacaaaacggtaaacccaatgtggtgatcgccaacaccgaaaaaggtgcggggatctcgtttattcaagggcgtgtggagtggcaccaccgggtgccaaaaggtgctgaaattgatctggcgctggaggaattaaacgatgagtaatgcagaacatttggcctcagtgatggtcgagcagtttatcaaggcggtcgataacggcgttgatttggtccccgtggttgctgactcgacttcaacggcaaaaattgggccgtttatcacacgcttccctgatcgggtggtcaacgttgggattgccgaacaggcgatggtgggcatggcggtcggcctatccatgggggggaaaattgcggtgacctgtaatgccgccccgtttctgatttcgcgtgctaacgagcagttgaaaattgatgtttgttacaacaacagcaatgtaaaactgttcggtttgaactccggtgccagctacgggccactggccagtacacatcactgtatcgatgacatcgccatcctacgtggcttcggtaatatcgaaatctacgcccctgctgatccccaggagtgccgtcagatcattgattatgcgttggcccatcagggcccggtatatattcggttggatggtaaagcgttgccgccactgcatgatgagcattatcgatttgctcccggtcaaattgatgtcttgcaagagggacgggatattgctctggtcgcgatgggatctacagtacatgaagcggtcagcgcggcagccatactggcagacaacaatatttctgctgcggtggtcaacgtttcctctatccgcccgtgtgatactcagcaactgttcgccatcctccaacagagtcagcgggtgattaccatagaagagcacaatattaatggcggcgtggggagtctggtcgcggaagtgctggctgaggcggggagtggtactccattagtgagactgggtattcctgacggtggttatgcgattgccgctgatcgggctgagatgcgtgcctatcatggttttgatgcggcaggcattgtggctcgtgctctgcggttttgccgaggggaataacgatgtcaacgccaatcattctggctattgatgaagggacaaccaacgccaaagccattgcggtagatcgtgccgggcgagttctggcgaaagcctcggtaccattacaactggaacatcctcagcccggttgggcagaacaggatccgctggcgatttggctggcggtttctcaggcggttgaggggtgcctaaatcaattggcgggcgcacaggtggcggggattgccatcagtaatcagcgtgaatcggtactgatttgggaacgggaaaccggcacgccgctcacgccagtcgtaagctggcagtgccgtcgttcagaggctttctgtctggctttgcgccaattaccggctgcggcgatggttgcggaacggactggattgcagattgatcccctgtttcctgcggccaaaattcacggcatgttggcgcagatccctcatggcgctgaacgtgccgctcacggtgagctgtgtgttggcacgcttgattgctggctgacctggcagtttagcgaagggcaaagtttctcgactgacttctctaatgcggcccggacccagctgtttaatatccattcaggtcaatgggaccccgatttactggcgctgtttggtatcccaagtctttgcctgcccgccgtcttaccctcggcatccatccacggacacaccgcgcgcaccgggattctcggcctggagcagggcgtgcctatcgtggcacacattggtgattcgcacgccgcgctgtacgggcaaggcggcgaccaggccggtgaaatcaaagccacttatggcaccggctcctctctgatgatgaccctaaaacaggcctgtgcaccaagccacggcctaagcaccaccattgcctggcatgacggcgaattacgctatgcccttgaaggtaacatcacccataccggctcaggagtggcatgggtctcgcgcatgttagggatcagtgatttgtcacgtctgactgacatggcagaaagccaatcaggtaatcaaggcgtctattttgtaccggcattatcaggactgggtgcgccttattgggacagtcaggcgcgtggtttgttctgtggtctgacggatgccacgacaccggcagtactggcgcgagcggcacttgaatcagtcgcttatcaaatagccgatgttttctttgcgatggagaatgcggctcatcatcgccttgaacggctgcgggttgatggcggtgcgaccagtaatcgctggctgatgcagtttcaggccgatttattacagcgcacattgatacgtaatcacacggcagaagtgtcagcactgggtgccgcgtatttgggcgggaaaacccttggttggtggcaggatagccaacaactggctgcgctcccccgtgaagtggaatacatcgaaccgcgcattcacagtgcggagatgcaagataactatagcctctggcaaacggccatcgcgcgtgcgcgttttcagccgaaataacccacactaggagtaagcatatgtcagcaatacctcgcaagttaacttttgcggtgattatcggcaatcggggtttcttcccaaactatctggtgagcgacgcgcgccgggatgctcaggcgctctttgaccggctggggattaacatcattatgcttaatgaagagcaaacgccactgggaggtgtggaaaattggcgtgatgccaaggtgtgcgctgaattattccgtcaacacagtgaagagatccacggtgtggttgttattctgcccaattttggcgatgagaaaagtgtctctgatgcgatccgtttatctggcctgaaagtgccggtcctggtgcaggcagaagaagatgcgctggataaaatggggctggcaacccgccgtgacagtttctgcggcaagatttcattgtgtaataacctacgccaatacggcattcctttcaccttgaccaaacagcatgtctgtagcctgaacagtgagatattcagccgcgatgtcgagcaatttgtgcagttgtgtcgtgtcgtacatgccatgaaacgggtacgggttggggctattggtgcccgtccgaccaattttaatactgtacgctacagtgagaagttattggagaatttggggatcaccgtagaaaccctcgatttatccgaggtgtttttccgggtggctaatctcagtgataacgatatccgcgtcggcgaaaaactggcattactgaaagccaatggcgataccagcactatcccacaagacaaactgcataaaatggcgaagttgtttgtggtgatcagtgaatggattattgctaatgatattgataccacggcgatgcaatgttggacgtcgctgcagcagaacttgggaatcaacgtctgttccattatgagcgtaatgtcggggcaattgatgccaagtgcctgtgaagtggatgtgatgggcgcgttatcgatgtatgcgttggccagttgctcgctggcaccggcatccatcgccgactggaataataactttggcgctgaacgagataaatgtgtgctgttccactgcggcaactttgccagtgaaagtctggagagctcaaccatgggtaccgctgatattatcgggacaacggtggggtgtgagaatacctgtggcgcagttcatggccggatgaagtcggggccattgacctatttccgcctctcttctgatgatttcacggggcaggtccgggcttatgttggcgaagggcgctctgtcagtgacgagttgaataccgtgggctgtcgggccgtggtggaagtgccacagttggagagtttgctcacgcatatttgcaacaacggttttgaacaccatgtggccatgaaccattcagctacagctcaggttttgcaagaagcattcagtaaatatctgggcgttgattgctactggcatgggaagccgtgaaacggaggccagcagccggtgatggggcaatgagataacccgcggcgtaacacgccagttgtctatgccctaaaataacgaggctaatggcaccgggatcacgatacaaagccagactgctgacaaaccccaatgacgcgatcttgaacggtgaggataagcagaagagtaaagtgtccgccccatggctggggctgttaaccaatatgttggcagggtggctagagtaatgtttctgctgtcagccggtcggtaattagcacatcaatgtagttaccggtcagtgcacctcgaatagcagcacttttctctatccccccagccagtgccacgacccgtgggcaagcacgtaattggggtaatgacattccaatgactgggtcttcctcatcgctgagtaccgcattgcccgcggcatcaaaataatgtaaacacaaatcccccacagccccgcgttcggccagtaatttcagcatctcttcgtggtaatagttgccggaatttttcagtaattgggagggttccagaacaccgatccccactaatgccagatcaacttcggcaaatttattcacgacatcggccacttcaccactggatatcaggcgggcacgatcttcagtagaacgttcaatgctttgtgcgggcaggagataggcagggcaatttaaaatatttgccaatgattgagttaacaatgtggcctgcacgttgccgttagggccgacacctccgagcaattgaatcacgccactggttttgatattgaggggatgaaggttatcgaccatcgcccggatggtactgctccatgaagaaatacccaccatatcgtttggacgaatactggtttgcatataatgggcggcagctgagccaatagcctgttttatctgtgcggggctggcgtcatcggtaatatccaccacaatggcctgatctataccatagtgtttttgaatacgtgattcgataccaataaacatattagcgggttgaatcacactgattttaaccacaccttctttgacacaccgcgttatcgcacgagacacgaaggattgagataaatgcaggctatcagcaatctcggattgcttcataccttcggtgtaatacagcgtggcaatcttgaccagtaaccgttgttcatcttgtcttgacatggttccatcccgctaaatacctcatgctggtatttttattcaatgctgaataaataacaagcagtacacgatttgcctgtagcttaactgcatattattggccgtggtactgggtgatgaccgcagcaaatcaaggttgccaataatgtactgaggaaaaacggctcttaccttgatgggcatcatattattttgtgacgcagatccggtgtgtaacccagcgccatgacatcattgtgacatcatatcattgtgaatgaggtgatggcgttgtatcaggatcagataggctgtccgccggggtgttaatggttgcgggttgctccggtggtggcataacgtcctggatcatctgctcgtcaaagctggggttcaatgcagatgatagcggtgaactgaccaggcaatcggggatcgctatatgaggtactggcgcatcattaacaaattcgtcttggtcctgttttacggttctgcttagcgcgatcaggcccaagccgcagagagaaaagaacgcatacagaatattccctcccaatggtgccatcagcgcgcctacgacgagaggcccaatactggcaccgacaccaaatgacattaataaacacgccgcgagtgagacccgcctttctggttcaatcaggtcattggcgagtgcgacgaccagcggataaagcgtgaactgcaacagactgacgacaaagcccaaactgagcagaaatcggaaagaaatatggggtattagtgccagcggtaatgcggttaatgccagtaagagagcgttaattcggatcaattgtgtccggttatagcggtctgataaccaactgagtggaaactgggcgacaaggccggcgaagatagacaatgccataaacaagccagtctcctgcgttgagagggattgcaagctgctataaaccggtgccaagccataaaacgagccgacaatcatgccgatgaccaatgttgatgccagtattttggggatcgaactgacaaaaaatttcagctccatcggtgccggggacatttgctgagcattactgcgggtggtcagcgcaacaggcaccaaacagagcgcaaaaaagagggcaataaccattaaagtaatcagccccagcgcgggctgaaacataagcaccacctggcccaaggctagccccgcataggttgccgccatataaaaaccgaataccgtgccacgctggttcgatgccgcttgatcattaagccagctttccagcaccataaactggcacatcatgcagaggccaataatcaagcgcagaactacccacgcagggatatattcagtaagcccatgacttaatacggccgcggtaataataccggcacaggcaacataagcgcgaatatggccgactctggcgatcaggaaatgaccgactttgccaccgataaccagaccgatgtagttagcggcaatgatggctccgattaatagtgctgaaacgttgatcgcagttaaacgtagcgaaatataggtggtcaacaaacctgagcctaatagcatcaacaccgttgcgctataaagtgggaagaaggtattgaaaatttttttcacgctattgtccttagttcctcatcgcggataaattactggcaccgcagatgtcactgtcgcctcttattctgttgataaaaaagacgatcatgattttttatccccttttaaaaaggggttttctcccctctcaccgctattcgctcggctcttttgatactaacagctaagccccacaggtaaagctttgtacgggaaagtacttattttcattacatgctgcgagacgtttcgcataactgagtgtggttgctatcgcaggctaaagaagtgctactatcggcagcaagaaatttatttagaatggggggcaacaatgagcgaaggacaactacgtcaactcagtattgcggttgggcataagttaaaagaacacggtgcgtgggtgacctgtgcagaatcttgtactggggggtgggtagccaaagccctgacggatattgctggcagttctgcttattttgaccgcggttttgtcacctacagcaatgcggcaaagcaagatctattgggcgtatctgaaacgaccttagcgcgttatggtgcggtgagtgaggccgtggtacgtgaaatggcattgggggcattgaaacaagccaatgcagactttgccgtttccattagtggtattgcggggcctgatggtggcagcgcagataaaccggtaggcactgtctggtttggttttatctcacgcgaagggccgattagtgcaagaaaaaaacacttttctggtgatcgtgactcagtacggttgcaagcagctgttttcgcactacaaacactattcgatgattttctgtaaaaataggcttgatactgtatgattgtacagtataattagcggtaatttcttgtacaaaataacattcagtggcgatggtagggggaaccctggcataccagagagggaataaaaatggctattgatgagaataaacaaaaggcgttagcagcagcactgggccaaattgaaaaacaattcggtaaaggctctattatgcgccttggcgaagaccgctcaatggatgttgaaaccatctctaccggctccctttcccttgatattgcactgggggctggtggcttaccaatggggcgtatcgttgagatttatggcccagaatcatcaggtaagacgacactgacattacaggttatcgccgccgcacagcgtgaaggcaaaacgtgtgcatttatcgatgccgaacatgcccttgacccaatctatgccaagaaattgggtgtagatattgataacctactgtgttctcagccagatactggcgagcaggcactggaaatttgtgatgcgctgactcgctctggtgcggttgacgttatcatcgttgactccgtagcggcattgacaccaaaagctgaaattgaaggtgaaattggcgattctcatatgggccttgccgcgcgtatgatgagccaggctatgcgtaagctggcgggtaacctgaagaatgcgaataccttactgatttttatcaaccaaatccgcatgaaaattggcgtgatgtttggtaacccagaaaccactaccggtggcaacgctcttaaattttacgcttctgtacgtttggatatccgccgtattggtgcagtaaaagatggtgatgtggtcgtggggagtgaaacccgcgttaaagtcgttaaaaacaagattgccgcgccattcaaacaagctgaattccagatcctctacggtgaaggcattaacatcaacggtgaactggttgacttaggtgttaaacacaaactgattgagaaagctggcgcatggtatagctataacggtgataaaattggtcagggtaaagccaatgccagcaactatttaaaagaaaacccagccattgctgctgagttagataaaaaactgcgtgaaatgctacttaatggcggcaatggtgaacaacctgttgctgcggcaacagcagaattcgccgatggtgtagatgaaaccaacgaagaattttaatacgcaactttaaccagttggagtaaacaaacagaccgtcacttgtggcggtctgtttgtttgagtaaataacatcagtaagtgattcgggtgagagagcgcagctaacaccgctgtagcggtaagtaaaagggtgttacccaaagtaattggtgttacagcaaggcagccagagaacgagtcccgatgagcttacatcagtaagtgattcgggtgagagagtgcagctaataccgctgtagcgacaagtaaaaagggtgttacccaaagtaattggtgttacagcaaggcagccagagaacgagtcccgatgagcttacatcagtaagtgattcgggtgagagagcgcagctaacacagctgtagcgacaagtaagaagggtatatgaatgaccagttaagtcgtgcaatgagactactctcccagcgtgaccatagtgaatctgaactgcgtcgcaagcttgcggcacctccattttcggcaaaagggaattggggaaagcgttcaggtgctaaaagcagtaatctagttgaaagtaacccagttgaaagcaatttagctgaaagtaatgcaattgaagagagtgatcctcaggttatcgagcaggttattgactattgttatcagcacaattggttggatgattcccgttttgccgccagctacattaatagtcgtagccgtaaaggatatggcgtacagcgtatccgttcagaactgatgcaaaaaggtgtcgataaagaacgaattctggctgcttttgagaacagtgagatcgactggtgccaactggcaaaagaggtcgcccagcgtaaatttagtgaaactttacctgttgaatggaaagaaaaggctaaagttcagcgttatctcctctatcgtggcttcttccaagaagaaattcagtcaatttacactgattctgtcgaatgaatgcacgtgggattttacttccttctgaagaaaatttatcttattccaacttttgttcgtgagcttatccattgcgttgtcgctaatctgtacacgatttgctcacgggccatccttttagcttgatttcaggacaattatgagcaagagcaccgctgagatccgtcaagcgtttctcgatttcttccatagcaagggacaccaggttgtatcaagcagctctttggtccctaataatgaccctacgctgttgtttaccaatgccgggatgaaccagtttaaggacgttttcttaggtttggataaacgggcctattcccgtgcgacgacctctcagcgctgcgtgcgagcgggtggtaagcataacgacctggaaaacgtaggttataccgcgcgtcatcatactttcttcgaaatgttgggtaacttcagcttcggcgattacttcaagcatgatgctatcaacttcgcttgggagttactgaccagtgaacagtggtttaatttaccaaaagaaaaactttgggtaacggtgtacgagaccgatgacgaggcctataacatctgggctaacgaagtcggcgttcctcatgagcgtatcatccgtatcggtgataacaaagggggggcctttgcctcagataacttctggcaaatgggtgataccggcccttgtggcccatgttcagagattttctttgaccatggtgatcatatctggggtggtcctccagggtctgcagaagaagatggcgatcgctatatcgagatctggaatatcgtctttatgcagtttaaccgtcagtctgacggtacgatgctgccattgccgaagccatcggttgataccggcatggggctggaacgtattgctgcggtattacagcatgttaactccaactatgagattgacctgttccgtgatttgattgccgcagtcgcagatgtcacgggggcgacggatttatccagcaagtcgttgcgggttattgctgatcacattcgttcttgtgctttcttgatttcagatggtgtgatcccatcgaatgaaaaccgcggctatgtcttacgccgtattattcgccgtgcaattcgccacgggaatatgttgggtgcgaaagagactttcttctacaaactggtggctcccttgatcgcggttatggggcctgctgctgctgagttaaaacaacagcaagcgatggtagagcaagtattaaagacggaagaagagcagtttgccaggacgttagagcgcggtttggcgctgcttgatgacgagctcagcaagcttaccggcgatacccttgatggggaaacggccttccgcttgtacgatacctatggcttcccagttgatctaacggcagatgtttgtcgcgaacgtaacctgaaagtcgatgaagctggctttgagcaagcgatggaagctcaacgtcgccgtgcccgtgaatccagtggttttggcgcagattacaacagcttgatccgtgttgatagcgcaagccaattttctggttatgaccatgtccaacaacacgcgacggttactgctctattccgtaatggcgaggccgttgatgagattcacgcaggtgaagaagccgttgtcgtactgaatcggacaccattctacggtgaatcgggtggtcaggtcggcgataagggggaactgaaaaatgcgacagcaacctttagcgttactgatactcagaaatatggtcaggctatcgggcacgtaggaatattgactaccggcacgttaagggttaaccacagcgtcgaagcattggttgatgttgtgcgtcgtaaccgtatccgtctgaatcactccgcgacccacttactgcatgctgcgttgcgtaacgtcttgggcgagcatgtggcccagaaggggtcactggttaatgacaaatatctacgctttgatttctctcatttcgaagcaatgaagccggaacaaatccggttggtagaagacctggtcaatgaacaaatccgccgtaacatgccggttcagaccgaagtgatggaactggatgcggcgaaagaaaaaggtgcaatggcactgttcggcgagaagtatgacgaccaagtacgtgttctgaccatgggtgacttctcaacagagttgtgtggggggactcatgctagccgcacgggggatatagggttattccgcatcctgaccgaatctggcacggctgcgggtattcgtcgtattgaagccgtcactggcgagggcgcgattgctttattgcatcagcaaagcgacctgttacaggacgtcgctcatctggtgaaaggtgatattcataatctggcagacaaagtccgggcggtattggatcgcagtaaaatgcttgagcgtgagttgcaacagttgaaagatcagcaggcagctcaggaaagtgcctcgttgtcttcaagcgcgaaattgatcaatggtgtgaagcttttggtcagtcagttggataacgttgaaccaaaaatgctgcggacaatggtcgatgaccttaaaaatcaactgggttctgccattattgtattggccaccacagctgatgataaggtaagtttgattgttggggtgaccaaggacctgacaggtaaagtaaaagcgggtgaattaatcgcggacattgctcagcaggtgggcggtaaaggcggtggtcgtcctgatatggctcaggcggggggtactgatgtgcaggctttgccagcggcattagccagcgtagaagcatgggtagcatcccggatgtaagtaatcatctattaaatcaacacgccatatctcggtactaggtatggcgttttttaattttcctgtcatagttcaatcacaaagttaaacgcaaagttgtttgcttcagctaaacttgtattagttagggactcgaccaagctacttacattttatatgaatgtaatggcttacgttttcacggtgtatgatggataatggcggggaaacagagagacccgactcttttaatttttcaaggagcaaagaatgcttattctgactcgtcgagttggtgaaacactcatgattggcgatgaggttacggttactgtattaggggttaaaggcaaccaggttcgaattggtgtaaatgctccgaaagaggtttctgttcaccgtgaagaaatctaccagcgcatccaagcagaaaagtctcaaccgacgacttactgattttgaagcagcgtctcgtgtaacacgaggcgctactgctttttattgtctctactctctgttttgtttcccctaattctcctttcttttcgctatttctctctacttcgtctgcccagtcactaccgctcagataaattcaacttctcctgtatttggttatatcccaataatcgctatcttgcctgttgataaaacactctttttggtttcaaactggccatgttgtgtgtgaagtgtgcaaataaacgcgagttgggaaaaattgtttgacttataagtgcgggaaagtaatatgtgcgccacgcagtgccgatgagcttcttcaaaagcaagttaggtacaattcgcaagaagcgtatggtgaggtggccgagaggctgaaggcgctcccctgctaagggagtatacggtcaaaagctgtatcgagggttcgaatccctccctcaccgccatttactatgcacccatagctcagctggatagagtactcggctacgaaccgagcggtcggaagttcgaatcttcctgggtgcaccatattttgcagtatggtgaaatagataaatgaacatcaggtagtgtcaaagaattattgcacccatagctcagctggatagagtactcggctacgaaccgagcggtcggaagttcgaatcttcctgggtgcaccatctttctaagtcatacatcttgctgttaagtttcactcgctgaaacgcctccgtaaaacaaacaaagaaacaaacaattgcacccatagctcagctggatagagtactcggctacgaaccgagcggtcggaagttcgaatcttcctgggtgcaccatctttctaagtcatacatcttgctgttaaatttcactcgctgaaacgcctccgtaaaacaaacaaagaaacaaacaattgcacccatagctcagctggatagagtactcggttacgaaccgagtggtcggaagttcgagccgagcgtagcgagacaacgttgctttagcaacggcccgtagggcgaggcgtaagccgagtcatcttcctgggtgcaccatattaaggaacctcgctatagcggggttttctgcttttggccgtaataaattcaccctacattaaacatctgaattctcttatcctgttttttactcgctcactaagccatttttacgtcatctaatagcaatttaattaagtgctaattctattttctatataaaattcaattgattatacagtgagcgacaatttagttagtttgcgataaagtagcttttcattttattcatgggggtgggctaacgatgtacgatctttatgaaggtctgatttttgatatggatggcaccctcttagataccgagtctacccatcgtcaggcatggcggcaggtgcttgcgccctatggtatgcactttgatgagcaagctatggtcgcgttaaatggcgcacctacctggaaaattgctggtgtgataattgctcataaccaatcagatctggatcctcattttttagctgcacaaaaaacttcattggtgaatacgatgctactcgataacgtgaagcctctaccgctcatagacgtggttaaatcctattatgggcgcttacctatggctgttgggacgggaagcgaacacagcatggcagagatgcttttacgccatcttggattacgtgattattttgatgccatcgtgggggctgatgatgtgacaaagcataagccagagcccgagacatttttacgctgtgcggagctgctcggtgtacgtccagataagtgcattgtcttcgaagatgctgattttggtgtagaagcggcaaaacgagcgaatatggcaatagttgatgtacgtctgctgtgagtaatactcttgcaattgcttcattattcgggagtagctttctcagtgcgacgctcttacccggcaattctgaaattctgttggtcaccctattaactgcgggtagtgcgcccgcagcgatattggtgttatctgctactgtcggaaacaccctagggggattaaccaatgttgttataggtcgtttattaccggaattaaagccacagcgtggtatgggggtggcacttggctggctccaacgcttcggtccggcagctctgttattaagctggttaccgatagtaggcgatttgatgtgcgtgttggcaggctggttgcgtatgccttggggttttgtggcttttttcttatttttgggaaaagcattgcgttacatcgtgttaacgatgattacgttgcaagggatcgcttggtggcaataatagatgtgacaaacttacgtagtcacatctatgcagtttcagtatgctgatgagttatggttttcaagagcgggaggtcgatttgatcccggatgtatcacacgcgttgacttggttggaagcgcatcctaaagccctaaaagggatccgtcgcggtatcgagcgggaaacattgagagtgactgccgatggccatttagcctcgacgggccatccagaatcactgggtgccgctttgacacatcaatggatcactaccgatttcgctgaggcattacttgagtttattactcctgtcgatggtgacattgatcatctgttgacttttttacgtgatattcatcgttatactgcacgtaagttgggtgatgaacgcatgtggccgctgagcatgccttgttttattgaggctgaacaggatattgagctggctaaatatggttcgtctaatattggccgctttaaaacactttaccgtgaagggttaaaaaaccgttacggtgcgctgatgcaaacgatttctggtgtgcactataatttttctttgccactggagttttggcaggcatgggcaggcgtcaccgatgagcaaagtgggaaggaggagatttccgcaggctatttccgtctgatccggaactattaccgctttggctgggttattccttatctgtttggcgcatcaccggccatttgctcatcgttcctgcaggggcgcgagacggcgttaccgtttgagcgtaatggtaagggaatgtgttatttaccctatgctacgtcattgcggctgagtgatttaggctataccaataaatcgcaaagtaatttaggtatcacatttaatgacctgcatacctacgttgacgctctgaaacgtgcgattcaaacaccatcagaggagtacgtggctttaggtctgaaagacggtgatcgccatctgcaactgaatactaatgtgttgcagatagagaatgagttgtatgctcctattcggcctaaacgggttacccgcgcgggagaatcaccgtcagacgctttgcttcgtggtggcattgaatatatcgaagtgcgttcgctggacataaatccattctcacctattggtgttgatgcggtgcaagcgcgtttcctcgatttattcctgatttggtgtgtgctggctgatgcaccagagatgagcagtgatgaactgctgtgtacgcgtaaaaattgggatcgggtcattttagaagggcgtaaaccggggcagaccattgggatagggtgtagtgattcccgtcaaccgctggaaacggttggtaaggcactgtttgctgatttacgtcgggttgcagaggttctggatgggagcgagagtgcatcgtatcagcaggtttgcgatgaacttgtcgcctcgtttgatgatcctgaactgacgttctctgcccgtattctaaaggtaatgcaagagaaggggatcggtggagttgggcttgagttggctgagcattatcgagaaatgctgcaaaacgaaccactggaactgctgacggaagaacagttatctgcagagcgcgatgcttcacggcaacggcaacatgagctagaactcaaagataagctaagctttgaagagtatttagcgcttcatggtggccaataaaaaagaaaaggccacatcactgtggccaaattaacatctctaatagaagggatgatgataacaaatgcgcgtctttcacatattaagacgtgcaggatgagtaaaagtttcatcagttgcgaaaaaaagattagaaaaatatgacttttttatgaggaggtaactaaatgccattattggatagctttaccgtagaccataccattatgaaagcaccggcagtacgtgtcgctaagacgatgaaaactcctcatggcgacgagataacggtgtttgatttacgcttctgtgtgccgaataaagaagtgatgccagagaaagggatccatacgctagagcacttattcgctgggtttatgcgggaccacctcaatggtgatggtgttgaaattattgatatctcgccgatgggatgtcgcacgggtttctacatgagtctgatagggacacctgacgagcaacgggttgctgatgcctggaaagcggcaatggcggacgtgctgaaggtcactgaccagcggaagatccctgagctgaatgaatatcagtgcgggacttatcatatgcactcgctggaagaagctcagagtattgctaaagatattcttgaccgtgatgtgcgtatcaaccacaacgaagagttggcactgccgaaagagaaactgactgaattgcatatttagtgctcagtatcagtaggcaggagaatgataaaaggcgctgattaaagcgtcttttttattaaactgactatcgcttagacagaattatttatagggtcgaatgttctgcggaagtcattggggtaattttaacccgcttaatcatattttcctgcacatcaagtacttcaatttggtaatttccaagacggacgtgaatatgtgcttgcggaatttcttctagctcttccagcaacatgccattgatggtgcgggcatcgacgggtaatgaccagttaaaggctttgttcacttcgcggacgctggcactgccatcaatcagtaccgagccgtcgctctgtggattaacttcttccgcaagcgtaggggacattgaggtggtaaaatcacccacgatctcctccagaatatcttcaactgtcactaaaccttgaatatcaccatattcatcgacaatcatgccgactttctttttattacgttggaatttcaccagttgtacattgagtggcgtgccttcggggataaagtagatttcatcggctgcacgcagtaggttctctttattaaattcctttttctccgtcatcaaccgataggcttcccgcacacgtagcatgccaatagcgtcatccaaggactggcgatataacacaatgcgaccatggggcgagtgtgtaagctggcgcatgattgacttccaatcatcattaatatcgataccgacgacttcattacgcggtaccatgatatcgctgacagtcactttctccagatctaatactgaaatcaacatgtcttgattgcggcgagagatttttgattgggactcactcactatcgtgcgtaattcatctttactcatcgcatcactgctgcgcacatttcctctaatgccacataaatgcatcaacccgcgagtaatggtattcagtagccacacgagtggcagcatgatcttttgcaggggggtcaggagcatactgctagggaatgcgacacgttcaggataaagggcagcgatagtttttggcaggacttcagcaaaaatcaggatcacaaaagttagcaccccggttgcgatggcaactccggcatcaccgtataaacgaataccgacaatcgtcgccagcgcagatgccagtatgttaaccagattattgccaatcagtaccaaacttattaggcgatctgggcggttcaggagcttttccacccgacgtgcggcacggttgccttgtttggataagtgacgcatccgataccggttaagtgtcatcatgccggtttcggatgcagagaagtaagctgaaacgatgatcataatgactaagataatgatcaatgagctagttgatacgtgctccaacacagtattccttatcgtgatgaggcctcagccagttccgttgggccttgtgtaggtggttgcggtaatcactagcgaaccataatttcctggaccagacggctaccaaaataagccagtgtaagtagaaaggcgcccgcaaaactgaaccaaatgaccctacgcccacgccaaccttcatgataatggccccacaataaaacgatatagacaaaccaggccataatcgataacaccgctttatggacattttctttactgaagagattatccatataaagcaaaccggtacaaagtgtcagtgtaagcaataccaccccaatttgggtgatatggaacatttttcgttcaatgctcattaacggcggcatatcagcattaaacgtcagtttcttatgttttaactgataatcaagccaagccagttgtagcgcatacagcgccgcgatgataagcgtggcataagcaaaaagcgccagaccgatgtggataaatatctctgggctggcttccaaatgggtaataaactcccctggaagcaggctggcaagcgccagattgatcatggcgaagctatagacaatagggagtaaaaaccagccacgcccttgtgaagcgacaatggtcataatcgtacagatcatcagcccaacaatagaaccaatgttcagtaacgtaagattctgaccaacgccaacatcaaaaatttgatttttcaaggcaatagcatggcacactagtgccacgacggcagaaaccagcgctaaccgccggtaagcactatttttccgcaccagacttgggataatcagccccaagctgagcgaataagcaagcaaagccaaaatggaaaacacgggcatagcgttatatgagcatcggctaagggaattagatagccagtatagcgttgagagcgttcctctccaaccgttctccgacgtgagggcagagatcgtttgcacttcgtgttataatcccctaattgtgtcgccagagcggcctgtttccacgttgagtatgagacaatgtttgagaacttaactgatcgattgtcgcgcacactgcgcaatatcagcggccgtggccggctgacagaagaaaatattaaagaaacgctacgtgaagtgcgcatggcattacttgaagctgacgtcgctctgcccgttgttcgtgactttataaaccgagtaaaagagcgggctgttgggcatgaagttaataaaagtctgacgccaggccaagaattcgtcaaaatagttaaaaatgaattgatcagcgccatgggcgaggtcaataacgaactgaatctggctgcacaaccgccagcagttgtgttaatggctggcttgcaaggtgcgggtaagaccaccagtgtagcgaaactggggaaatttcttaaagaaaaacagaagaaaaaagtgctggtcgtgtctgctgacgtttatcgccctgcggcgatcaaacagttggaaaccctggctcagggtgttggcattgatttcttcccgtctgatgcacaggaaaaaccgattgatattgtgaatcgtgccctgcaacaggcaaagcttaaattttatgatgttctgattgtcgataccgcaggtcgcttacacgttgatgaagcgatgatggacgaaatcaaacaggttcatgcggcgattaagcctgttgaaaccttgtttgtcgtcgatgcgatgaccggtcaggatgcggcgaatactgccaaagcattcaacgaagcactgccactcaccggtgtcgtgctgactaaagtggatggcgatgcgcgcggtggtgcggctttatctatccgccatatcaccggtaaacctattaaattccttggcgtcggtgagaaatctgatgcactggaaccgttccatccagaccgaatagcctcacgtatcttgggtatgggcgatgtgctgtcgctgattgaagatatcgaaagcaaagttgaccgtgtgcaagcggagaaactggcaacaaaactgaaaaaaggcgatggtttcgatctcaatgacttcctcgaccagttgaagcagatgcgcaacatgggggggatggccagtatgttgagtaaaatgccaggggcaggtcagttgccagaaaacgtaaaatcgcaaatggatgataaagtcacggtgcggatggaggcgatcatcaattctatgacgctgaaagagcgcgctaaacctgaaattatcaaaggttcacgtaagcgccgtatcgcaaccggttctggtgtgcaggtacaggatgttaaccgtttgctgaaacagtttgatgaaatgcagcgcatgatgaagaaaatgaaaaacggcggtttggccaaaatgatgcgtggcatgaaaggtatgatgccacccgggttcccaggtcgctaaaagccatctcacactgtggcgttaaccggtgtgaagtgagtaaagatttcccgcagaaaatggcggtaaacgatgaaaatggtactcagtacaaaatgtgcgaacaggaatctacgctttagattgcttttttcgccaaaatgagtaaaattttcgggctttttatattgcaactggaccccgttccccgatggggtccagttgttttattaactaaagaggatgttatggtaacaattcgtttggctcgtggcggcgctaaaaagcgtccgttctatcaagtagtagtgaccgacagccgtaatgctcgtgacggtcgttttatcgaacgtgtaggcttctttaacccgatcgcatctggtcaggctgaagcactgcgtttagacctggaccgtatcgaacattggatcggcctgggtgctaccgtttctgatcgcgtatctgtgctgatcaaagacgctaagaaagcagcttaatctgtcacggtggtggttattatgagcaagcaactcaatcctgcagttcccgaccagccgattgttctcggtaaaatgggttctacttacggcattcgcggttggctcagagtattttcatccaccgagaacgccgaaagcatttttgactatcagccgtggtttatccagcaggcgggtaagtggcagcatgtcgagttggaagactggaagcgccacagtcaggatctgatcatcaaagtgaaaggtgttgatgatcgggatgccgcgaatttactgactaattgcgaaattttcgtagattccacacaactccctgcattggaagaggatgattactactggaaagaccttatgggttgccaagtagtaaccaccactggttatgaactgggtaaaatcatcgatatgatggaaaccggttctaacgatgtcatggtcgtgaaggcaaatctgaaagatgcattcggtatgaaggagcggttggtcccgtttcttcatgggcaggttatcaagaaagtcgatctcactgctcaacgtgttgaagtagattgggatcctggtttttgacctccgaattaaacggcgatagcgagtggaacaaaacaatgtggatcggtgttattagcctgtttcctgagatgttccgcgcaataaccgattacggggtaactggccgggcagtaaaaaatggcctgctgagcgtgcagtgttggagtcctcgtgacttcacctacgatcggcatcgtaccgtggatgaccgcccatatggcggaggcccgggaatgttgatgatggtgcaaccgttaagggaagccattcatgcagcaaaagcagcggcaggcgagggagcaaaggtgatttatctgtcacctcaagggcgcaaactggaccaacagggtgtttgcgaactggcgatgaatcagaaaatgattctggtttgtggccggtacgaaggagttgatgagcgcgtaatcaaaacagaaattgatgaagaatggtcaattggcgattacgttctcagcggtggcgagctgccagcaatgacattgattgattcagtctcccgttttattccgggcgtactggggcatcatgcctcagcggaggaagattcctttgttgatgggttgctggattgcccacactacactcgtcctgaggtgttagaagggatggaggtaccgccagtattactgtcaggtaaccatgccgagattcgtcgctggcgcttaaagcagtcgctgggccgtacctggcttagaagacctgaacttctggaaagcctagctctgactgacgagcaaatggtgttgctggctgagttccaacgggaacataagccctgagcaacagaactatgaagggaacattgtgccgcgcgcaaatggtcctgatatatcagtttacctagggtaagagacttattatgagcaatattatcaagcaaatcgaacaagagcagatgaagcaagatgtacctgcattccgtccgggtgattccgtggaagttaaggtatgggttgttgaaggttctaaaaagcgtctgcaggcattcgagggcgtggttatcgctattcgtaaccgcggtctgcattctgcgttcaccgttcgtaaaatttccaacggcgaaggtgttgagcgtgtattccaaactcactccccagtaatcgacagcattactgtgaaacgtcgtggtgccgttcgtcaagcgaaactgtactatctgcgtgagcgtactggtaagtctgctcgtattaaagagcgtcttggctaagatacagctaacgctgcatccaaaagttaatacttatgaaggggctagccatgtgctagccctttttttatgctctatttttttagttggcagagactattctcgaaaaagagatgttcgcagaaaagaggtgttcttgaaaaaataaatgctcttgagaaataaatactcttgagaaatgaatattaggtattaagacaaggaaaaggcagagaggagaattagcgcggtatcacaccacgctatatagacgaatggtgggttacaggccgtaaaccaacgttattgacgtcgtagtgtccgtgtttttgggcgcactggttggcggcttagtattataggtcgcgatataagctaaacgtaatgcgaagcttttattgatagcaacattcaacgctgtttctgagttcaacgtcgtttcttcgtttgctaatgcggaaacaccttcactgaataccgtgttatccgtgagctgataagtatagttcgccccaccatatgctaatgctttagtcgctcggccaccgccataaaattcatcatggcgaacacccggaccaaattctacccgcagattgtgtagtggggttgtcataacctgacgaccataacctgtcgttaataccgagcgggagtcgaaaccattataacgatcagttagccaactggcttggccgaatatgtaatgacgatccgtcagattatagcgggtacggccaccgagttgataacgttctgaagaacgttgattattggcgctggtgttacgggccgctccccataagctataagctgtattgggctggaaccaagtcaatgttgagttagccgctaatgatgagtttgtcgtattgccggactgagcggtataacctgcgtcaacggaaccatcaaagctttttttagccgaggaaggatcatccaaggctgtaaagagagtcgcatcagcaagcgctgatgcactaaacaaggataaagtgagtgtgctgatataaaacggcaacgccttggtatgacgtaaagaaaacataatggacctatggtgaaaaaatgatgtttgtgatgcggctcgcattgtagcagttgtgattaaacttacttggaagatatagcggattgagtaattaattataatgacgtcctttttctcataagttcattcttaaaaatgatcccagaaaaataatttggcgttactgccaggtaaaacgaatggattccgataagcagactcaggaaaataattgggggtaatgaatgccattaatactgtggcagcgtcaaattagaaggggattaagagccagaaaatacactggccctacaaagtagactcctggatttatgattcactacataaacgtcgttaccagcagatagcccgtgatacaggagcaaatgacgccaataagacctggaatgataaagctatggttgataatgaatctaccaattttggtggtaccagagcggtcaaaaccgatacaagccagatcactcgggtaggttggcagaacaaaatatccgtaagctgctgggaaaaatgcgatgagcatcttaggttcaacgcctaattgtaagcccattggtgcgatcgctgctagcgccgcggcttggctgttcaccagcttcgagactaagaacagcacaatggcataagtccaagggtggccttttaccacatcttccagtactaatctcagttcacccatatgagcctggaagaaggtgtcactcatccaggcaacgccgaataccgagaagatagcaaccattccggctttgaatacggcaccgttagagatatcactgggtttgactttgcagccaatcaaaataacggcaccggcgatcagcatcatcatctgaatcaccagattcatcgacaaagactgtaacttgcctttaacttcaaaagcagggcgcaggtctgcaaaagcgcccaacaagacgacaacgacgatagcggcaaagaatatccaggtcgaccaataagcttgttttggaaaaacctgattcagcaacgtatctgttgagccatatatataggcccgctgctctggatcttttattttttcctgaaaatcaggatctttatccagatctttaccacggcgcaggctccacagggctgcgattagcactccaaccaaagaggcgggaactgaaatagccagaatttccagaatgctataggcatggccgatgccatggttagcaccaataattgaaactaatgatacgacagcaaccgatactggagatgccgtaattgccatctgtgaggcaacggatgcaaccgccattggtcgttctggacgaataccttttttaatggcgatgtcggaaattatggggaacatggtgtaaacgacatgtccggtgccgcaaagaaaggttaatgaccacgtcgtgaagggcgctaataacgtaatgtgctgtgggtggcggcgtaataatcgctcggcaaattgcatcattacatttaacccgcctgcggtttgtagtactgaagcacaaccaataaccgctaatattgttagcattacatctacaggtggttttcctggttcgaggccaaagataaaggtcagaataaataagccgataccacttattaaccccagccccatccctccgtaacgcgtacctaacagcaaacatagaattataattataaattgtagagttatcatgatgtccctcgcttcaaatatgaatgaaattcggttatgtatttgttggttttattcgatgactataatccttactcgatttctcttatcagagcacagatcacattgattaaaacttagctaatatcaagggagtactgtttatttaggtaattaattaaataaagtgaagtaagtagaaaagataaattaatatgaaattgaaatgtaaaattaatgtattaatattgtgctttaaattaatgcattaattttttaacggctattgctcatctatacccaaaataattcgagttgcaggttggcggcaaccgagtaatcaatgggcgggaaccgatttgaacagtatttatgctacccggagtaacgagcgtagccaacgcacatgcagcttgacgtatgatgggtatctctattcattccggagcctatttatgcgatgcctaatttctccttcagggactttaaatagcggcggctaacagggatatgctttcctgaacgagtgatgacttcagccgcaccattatccataagctgaatttcccccaattgttcggtattcaccatatattgccggtggcaccgaataaacggagttttttcctccagtgtttttaacgatagctgggtataacctgattgcacggttcccaccacatgcaccccgctaagctcggagcttaggtattctacttcttcaattttcagcaaaaaaatacggttgtggcctgaacaggggatatgacgaagtattggttcgataactttgtgtaaattattctttacgattaaatcgcgacttagacgtgtcagtgtcttcgccaaacgttgatggtcgagtggttttaacagatagtcaaaagcatgttcttcaaaagcgcgaatggcatattcatcgtaagcggtgacaaatacgatatgtggcatgctttcagggttcagcattgaggccaattctaacccattgattctgggcatctggatgtcgagaaataccacatcaggctgtaggcgctggatagcaggaattgcttccagagcattgctgcattcggcgacgatctcgataccgtgttcttcattcagtctttcgcgtaaatcttcacgcgcaggttgttcatcgtcgacgatgatgactcttaacatacagcctccacaaattttttctattttatcatggcctctgagggagcacgggaccaaggatggaaactgcgacttaccgcaaaagttagattgagatgtgcctgtaaaaaaatagtaattatttatttacacatatggattgaaaactttacatcacatggtattgtggagctctcaaacgataaatacgccagcgacatccgctaaacagagataggtaaagattatgatcatgcaaaaagactcgctcaataacgtccatatcagtgccgaacaaatcctgataaccccggaagaactgaaaaatcagtttccactgagcgaaaatgatcagtattcgatagagcgcgcacgtaaaaccattgctgacattattcaggggcgagatccgcgtctgttggtcgtttgtgggccctgttcaattcatgatgtggatgcggcactggattacgcgcgtcgtttgaaaaaactctctgtggaattggatgacagcttatatatcgttatgcgtgtctattttgagaagccaagaactaccgtgggttggaaaggcctgatcaatgaccctgcaatggatggttcatttgatgtagaggcaggtttacacattgcccgtcgtttattgctggatttagtgggcatggggttgccgttagcgactgaagctctggatcctaatagcccacaatatttaggtgacctgttcagttggtcggccattggtgcccgtacaacggagtcacagacccaccgtgaaatggcatcaggcttgtctatgccggttggatttaaaaatggcactgacggtagcctaggcacggcaatcaatgcaatgcgcgccgctgccatgccacatcgctttatggggatcaatcagtcgggccaggtctgcctgttacaaactcagggtaacccacacggccatgtcattctacggggaggtaaaacaccaaactacagtgcacaagatgtcgctcagtgtgaaaaacagatgcaggatgcgggactcatcccatccttaatgatagattgcagtcacggtaattcaaataaagactaccgccgtcaggttgcggtggctgaatctgtggttgaacagatcaaggcgggcaatcgttcaattacaggtgtgatgctggaaagccacatccacgaaggaaatcagtcatctgaacagccacgtgctgatatgcgctacggtgtttctgtgactgacgcctgtattaactgggaaagcactgaaaccctgttacgtggtatgcgccaagaattgcttgcagcactgacggcacggactgcatgaggaaaagtaagtatggtggctgaactgactgctttacgcgatcaaattgatgaagtcgataaagcgttgttggatttgctggctaaacgcctgcatttggtggctgaagtcggtgaagtaaaaagccgttatggcttgccgatatatgttccggatcgtgaggcggcaatgctggcctcacgccggcaagaagccggggcactaggtgttccgccggatttaattgaagatgtgctgcgtcgggtgatgcgggaatcttataccagcgaaaatgataaaggcttcaagacattatgcccggaactgcgtccagtggttatcatcggtggtcaagggcagatgggtcggttatttagccggatgcttaatctgtctggttatcaggtgagaacactggagcaagaagattggtcacaagctgaatctattctggctgatgccgggatggtgattgtgagtgtccccattcatatcactgaagaggtgattaatcggctacccaaattaccagcagattgtattttgctggatttggcctcggtaaaaaataaacccctgcaagctatgctggcagcccatgaagggccagttttggggttgcatccaatgtttggccctgatgtcggcagcttggcgaagcaagtcgtggtgtattgtgatggacgcgatccacaggcgtatcagtggttactggagcagctacaggtctggggagcaagattgcaccgtatcagcgcggtcgaacatgatcaaaacatggcgttcattcaggctctgaggcattttgcgacttttgcgtacggattgcatctggcggaagaaaatgtgcaattggaacaattgctggcactgtcttcaccaatttatcgcctggagctggcaatggttgggcggctatttgcacaagatccacagctttacgctgatatcattatgtcgtcggaagataatctggcgctgattaaacgttactacaaacgctttggtgaggcgctcaccttgttagagcaccatgataaacaagcgtttgttcaaagtttcgagaaagtagaacactggtttggtgattacgcggaacgtttcttggtagagagccgttcattactgcgtcaggcgaacgataatcgtcagtagtattcatcagcaagtgatagatttttataggtcatcccagcacagcctgccgggatgactttttttatggtgtgggcgcataaaatgagcctgaataaagggcgttaccgaggctcgacgggaacgacgttctcacttgggtagcagcccaacacttttaaggaacgggtaatcggtgttagatcggccaatgctttttgcatcgcttctgaacgtatattggcctgcacatcaatataaaacatctcttcccacgggttgccattaattggccgggactccagtttcgtcatgataatgccatgctctctgagtaccagcaaagcctctaccaatgccccggattgctgcccggtcgccataattaaggtggttttggccgggatttgctcagatacatcaatgggtttgcgggcaaggacaatgaatcgagtaatattttgttgctgatttgccagattgtgctccagcacttgcagattatagagcgcaccgcccgcttcgctacctaatgcagccgccgttggtgatttcattcctgcaactttttccatcgcggcagccgtactctcacaatactcaattttccaatgtgggaaacgattaatgaactggctgcattgctggaaaggctgaggatggctgtatacagtctcaattttgttcaaatctgtttctgtggcaatgagtacgcagtgctcgatagggttggttatttcgcccacaatagacaagctggtgtgttggagtaagtcatacacatcattaatagaacctgaactggtattctcgataggcagtacggcgtaatccgcttgcccggtttcaacctgggtaaaaatgtcttggaatttcaggcaaccgcattcaattaattgctcaaaatgacgtgctgcatattggcgagctgccagatgtgaataggagcccttagggccaaggaaggcgatacgggcagagagcagggcggtttggttaagctgatgttgcaataaagcctgctgggtcaatacggaatcttcaataatcagctgaaacaggcgtgtgacatagaatccatcaagattataaggcttagcggcatcgatcagtgcgtctaataagtcacgctcacgttctttatcgcgaattgggcgatgatggagctgcttggctttggccacatccactgccagttcacgccgttctgccagcaaagccagcagttttaaatctaatgcactgatacgttcacgcagcaccagtaatggattatcggtcatagacttttgccttataatttttatgaatgattacactttcaataattcgagttgcatgaaagcgactaacgcacatgcagcttgaagtatgacgggcatatacataaaaaaagcctcccgcttgggaggctttcttgttcgtcttcgcattctttatcacacgacgaaacgcctcccaattaggggaaggtaaaaaagaatgcgaagaaaaacactttattgagaatcactacggtttacctattttaaaactcacggtttctaaaaaatgaacacagctaaattaaccgccagtctgaattgatgtcaattaaaaacgcgcccgaaggcgcgttacaccgaaattagaaggtttagttggctattgttccggttcggattctgtttcctcttcatctacagactccaaattagcgtctttaacgctgcttgccgcacgacgagcttcacctttgtgttgaactttatttaattggcgttctagtttggtgatcagttcattaatggcagcatacatatcatcatgcttggcgctggcgaccaagggacccattggtgtactgatagaggcatcggcaacaaaaccttgtggctctttagacagtacaatgtgtgggtttattaactgggcctgccatttatccagtttggtgagacggtcctcaacgtgtttacgaattgccggggtaatatccatttgcttgctggtaatattaactgtcatatgacttacctctctgtctactccgtcttggataacttcagcatacctcgctttaccgtagaatgtatgatcgagatcacttttttttgtcactttttgcaaagctcgtgggaactgtgatttaacctcaggaacaggctttgagggcttgaatcattggttataatgtcgcattatcgataggttatatcgcccgcatatagttaagaatgacactatttttgagcctaaggtgggacgtgtttttatctttaagcgggaacgttgatctttagctaaaaaactaaagttgaaaacctaaattgaaaacggcagcctgagctgccgttggtgttttcatttttcgggataatgttaggctggattggccgcaattatcttcgcgactttatctgcctgagcattcagttgcagctgcttataagcattttccatcaacggcaaggcatcacgagtggcttgcgtatctggataatctctcatcatttgatctacacggttaacaaccgcgacgtaagcacctcgtttagtgtaatattgcgccacggccaattcatatttggccagacgatctttcaggaacaccaggcgtttttgcgcatcagttgcgtattggctattcggatagttttgaatcaactggttaaaatcgcggaatgcggcccgagcatgttgcggatcgcggtctgaacgatcaattccgaaaaagccttgcaacgcgctgtcatccagagccatgtccgtcaaaccacgcatatataatacgtaatcgatgttaggatgggtgggattgaggcgcataaagcgatcgattgaggcttgcgccataggcagatcagcagatttataatacgcataaatcaaatcaagctgaacctgctgggagtaaggcccaaaaggatagcggttatctaacgcttctagttgcgtaatagctcccttaaagttaccgtcctgcaacttttgctgtgcggtagcatagagctcagaaggcgggttatcgggaaccacgtccttgttactggagcaaccggtcagcaccaggctcaacgtggcggcagccaccagatatttcatacgcgtcatgacgttttgattatcctcgaagtgttattccgggagactgtccgttaagctcccgatcaagatctagatacaatagcacattatattaaacggcatcgccgtcaaaacccaacgttaacgaacaagaagctgcatatggcacaacaagtacaactcagcgcaacggtggccgaatctcaactcggtcaacggttagatcaggctttggccgaattgttcccagattattcaagatctcgcataaaagagtggattttggatagtcgggttacagtcaatggtaaaaaaatcaacaagcctaaagaaaaagtgttgggtggtgagctcgtcgcaattgacgcgcaaattgaggaagatgcccgttgggcgcctcaagaaatcccacttgatatcgtgtatgaagataacgatattctggttattaataaaccccgaggtttagttgttcatcctggtgctggcaatcctgatggcaccgtgctgaatgctttgctgcattattatccagaaatcatggatgttcctcgcgcaggcattgtacatcgcttggataaggacaccaccggattgatggtggttgcaaaaacagtcccggcacagacccgcttggttgaagcgttgcaagcacgtgaaattacacgtgaatatgaagcagtcgctatcggtaatatgaccgctggcgggagagtggatgagccaatttctcgccactcgactaaacgcacccatatggcagtacatccaatgggcaaaccggcgacgacacactaccgcattatggagcacttccgtgcccatacccgtctgcgtctgcgtttggaaactggccgtacacaccaaatccgtgtgcatatgtctcatattaaccatccgctggtgggtgatcagctctatggtggccgcccgcgtccgcctaaaggggcgtctgattcctttattgccatcttgcgtggctttgatcgtcaggctctgcacgcaaccatgctacgtttgtatcacccaatcagcggtattcaaatggaatggcatgccgcattaccagaagatatggttgagctgattaatgcgttaaaagccgatactgaagaatttaaagatcagatggattggtaagatgagcacactgatactgcccgattggccgatgcctgcccgcgtccgggcttgtagcaccactcgtcatggtggtgtcagtgtgtcgccttatgattcattaaaccttggtacgcatgtgggcgatgttgctacccatgtggacgccaatcgccaacttctacgggaacaagcctgcctaccacaaatgcccgtttggctggatcaggtacacggtacccgagtcctaacacttgaggggcgttcggtatctaatacacaagctgatgcggtgtatagccgagtggcagggcaagtctgcgcggtcatgacagcagactgtttgccggtcctgttctgctccttagcgggtgatgaagtggctgcagcccatgcagggtggcgtggtttatgttctggtgttctggaacacacggtggcgcaattcaatgcggcaccgtcctctcttatggcttggttgggtcctgcgattggtcctcagcagttcgaggtcggtgaagatgtaaaacaggcatttatcagtatcgatgctaaatcagctttggcatttacccctttcggttctaaatacctcgccgatatctatctattagcgcgtttgcggctacaggcggcgggtatccaagctatctatggcggtaatcgctgtactgtgactgaaaaacaacaatttttttcttatcggcgtgatggtatcaccgggcgtatggcaagtttaatctggctaatataatatattgcgtcaggacgatccgctgacgtagaacgcattattttaatatagtgtcaaaataaccttgaaaaattgagggatgacctcatttaatctccagtagcaattttgaccaatattggaggtgttatgcgtctggatcgtcttaccagtaaattccagcttgccctcgccgatgcccagtctttagctcttgggcgcgacaaccagtttattgaaccgttacatttgatgagcgcactgcttaatcaggatggggggacggttcgccctttattgacctcggcagggattaatgttgcacgtttacgtagcgacattgagcaagctttaggtcgtcttcctcaagttgaaggcaccggcggtgatgttcaaccatcaaacgagctggttcgtgtattaaatctttgcgacaaattagcgcagaaacgttcggataagtttatctcttccgagctgttcgtcctggccgtacttgaagatcgtggcacgttaacagacatgttaaaggccgcaggtgcaaccgtcgctataatagataaggcaattgaaaccatgcgtggtggtgacaaagtcgatgatcagggtgctgaagatcagcgtcaggcgttgaaaaaattcactatcgacctgactgagcgtgccgagcaaggcaaactcgatccggttattggccgtgatgaagaaattcgccgtactattcaggtattacaacgtcgaaccaaaaataacccagtgctgattggtgagcctggggtgggtaaaaccgctattgtggaaggtttggcgcaacgcattgtgaacggcgaagtgccagaaggcttgaagcataagcgtgtactctcattagatatggggtcgctgattgccggtgccaaatatcgtggtgaatttgaagagcgtttgaaaggcgtactgaacgacttatcaaaacaagaaggcagtgtgatcttgtttattgatgagttgcataccatggtcggtgccggtaaaggcgatggggcgatggatgccggtaacatgctgaaacctgcattagcgcgaggtgagttacattgtgtgggggccactaccctcgatgaataccgtcaatatatagagaaagatgctgcgctcgagcggcgtttccaaaaagtgtatgttgcggaaccaacggtagaagacactatcgctattttacgtgggctgaaagagcgctacgaactgcaccatcacgtgcagatcactgacccagctattgtggcagccgcaacattgtcacaccggtatatttctgatcgtcagttaccggataaagctatcgacctcattgatgaggcaggttccagcatccgtatgcaaatggattcaaaacccgaatcattggatcgtctggagcgccggattattcagcttaaactggaacagcaggccctaaaaaaagagtcagatgacgccagtaaaaaacggttggaaatgctcaatactgagttagagcaaaaagagcgtgaatattctgaactggaagaagagtggaaagcagaaaaagcttcactcaccgggactcagaatatcaagacggagttagaacaagctaaaatcaccttagaacaagctcgtcgagtaggtgatctggctcggatgtcagaacttcagtacggtacaatccctgagctggaaaaacagctggcggcggcaaccgcgctagaagggaaaaccatgaagttgctgcgtaaccgtgtcacagaaatcgaagttgctgaagtcctggctcgctggaccggtatcccggtatctcgcatgttggaaagtgagcgggataagctgctacgtatggaacaggacttgcatcaacgagtcattgggcaagatgaagctgttgaagccgtctccaacgctatccgtcggagtcgcgcagggttgtctgatccaaaccgaccaattggttcgttcttattcttagggccaacgggggttggtaaaactgaattgtgtaaagcgttggcaacgttcttgttcgacagtgacgatgccatggtgcgaatcgacatgtccgagtttatggagaaacattccgtatcgcggttggtcggtgcacctcctggctatgttgggtatgaagaaggtggctatctgacggaagcggttcgtcgtcgtccttattctgtgattttgctggatgaagttgaaaaagcacatccagatgttttcaacatattgttacaggtattggatgatggtcgtttgaccgacgggcaggggagaactgtcgactttcgtaacacggtagtcattatgacctctaaccttggttcagatttgattcaggaacatttcggccaaatgaattacagcgaaatgaagacagtggttatggatgttgttagtcaccacttccgtcctgaatttattaaccgtatagatgaggttgttgtcttccacccacttggtcgggcgcacttggcttctattgccaacattcaactggagcgtttgtataaacgtctggaagaacgtggctatgaagtgaagattactcagcctgcattggaattcttgggtgaagctggcttcgaccctgtttatggggcgcggccattaaaacgtgcaattcagcaggaaattgagaacccgctggcacagcagatactttctggcaaactaataccgggaatccccgtgactttagatgttgaaaatgggcatattattgctaagcagtaatagctgatcctctaaggggcgagaaatcgccccttttttgttgtttttttcttcatatattgcatttatgatgcattagtgagcggttgaaaagttttttgaaattaggggttgcaggctgtcaggaactccctataatgcgcctccactgaccgggaacaacgaaacacacttcgccaggtcaggaagagaaaagcagacttgaacttcgaaagaaataaaagaaaaccttgactcttcagcgggaaagcgtattatctgcctcccgcgttaccgtaagattcgccgcaaggcaaacgggtaacgaacgctctttaacaatttatcagacaatctgtgtgggcactcgcaagacgatatcgacgcctgtttcggcaggcagaaataatatcaagtcttgaagagtgaccaaagcagtaaacattttgacttcggtcagaatgcatatttgcagaaagtaatctttgagcaccgctgcttttacgcaagtaaaagtcagcaaatcaaacaaatcttaaattgaagagtttgatcatggctcagattgaacgctggcggcaggcctaacacatgcaagtcgagcggcagcgggaagtagtttactactttgccggcgagcggcggacgggtgagtaatgtctggggatctgcctgatggagggggataactactggaaacggtagctaataccgcatgacctcgcaagagcaaagtgggggaccttagggcctcacgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggttgagtttaatacgctcaatcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaatttggcagagatgctaaagtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagccagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaacgatacgcattgcgcagtgcccacacagattgtctgatagaaagtaacgagcaaataaagccgggctgagaaattggtcgggctttagtaccttgttgggtctgtagctcaggtggttagagcgcacccctgataagggtgaggtcggtggttcaagtccactcagacccaccaactcaccattccctgttgagttgcagcaataaggtgatttgctttttatatggggctatagctcagctgggagagcgcctgccttgcacgcaggaggtcagcggttcgatcccgcttagctccaccatataaaactatttcaaaacgtactgcggtcgcaaggcacagtgtattgtgaaatattgctctttaacaatctggaacaagctgaaaattgaaacattacagctgaaatttaccccgccgtagatgtattggggtaaagagtaacctgtaatagagtctctcaaataatcgcaacacaagatgtactgtcagcaatgacaagacaccttcgggttgtgaggttaagcgactaagcgtacacggtggatgcctaggcagtcagaggcgatgaagggcgtgctaatctgcgaaaagcgtcggtaagctgatatgaagcgttataaccgacgatacccgaatggggaaacccagtgcaatacgttgcactatcgttagatgaatacatagtctaacgaggcgaaccgggggaactgaaacatctaagtaccccgaggaaaagaaatcaaccgagattcccccagtagcggcgagcgaacggggaggagcccagagtctgaatcagtttgtgtgttagtggaagcgtctggaaagtcgcacggtacagggtgatagtcccgtacaccaaaatgcacaggctgtgaactcgatgagtagggcgggacacgtgacatcctgtctgaatatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagcaccttcgtggtgtgactgcgtaccttttgtataatgggtcagcgacttatattttgtagcaaggttaaccgaataggggagccgtagggaaaccgagtcttaactgggcgtctagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatcttcgggggtagagcactgtttcggctagggggccatcccggcttaccaaaccgatgcaaactccgaataccgaagaatgttatcacgggagacacacggcgggtgctaacgtccgtcgtgaagagggaaacaacccagaccgccagctaaggtcccaaagtcatggttaagtgggaaacgatgtgggaaggcacagacagccaggatgttggcttagaagcagccatcatttaaagaaagcgtaatagctcactggtcgagtcggcctgcgcggaagatgtaacggggctaaaccatgcaccgaagctgcggcagcgacacttaggtgttgttgggtaggggagcgttctgtaagccgttgaaggtgacctgtgagggttgctggaggtatcagaagtgcgaatgctgacataagtaacgataatgcgggtgaaaaacccgcacgccggaagaccaagggttcctgtccaacgttaatcggggcagggtgagtcgacccctaaggcgaggctgaaaagcgtagtcgatgggaaacaggttaatattcctgtacttggtgttactgcgaaggggggacggagaaggctaggctggccgggcgacggttgtcccggtttaagcgtgtagggggagtgaccaggtaaatccggttgcttatcaaccctgaggcgtgatgacgatgcactacggtgcagaagcagttgatgccatgcttccaggaaaagcctctaagcatcaggtaacattaaatcgtaccccaaaccgacacaggtggtcaggtagagaatactcaggcgcttgagagaactcgggtgaaggaactaggcaaaatggtgccgtaacttcgggagaaggcacgctggcgttaggtgaaaggactagctcctggagctgaagccagtcgcagataccagctggctgcaactgtttaataaaaacacagcactgtgcaaacacgaaagtggacgtatacggtgtgacgcctgcccggtgctggaaggttaattgatggggtcagccgcaaggcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggccttgaagtgtggacgccagtctgcatggagccaaccttgaaataccaccctttaatgtttgatgttctaactcggccccataatctggggtgaggacagtgtctggtgggtagtttgactggggcggtctcctcccaaagagtaacggaggagcacgaaggttagctaatcacggtcggacatcgtgaggttagtgcaaaggcataagctagcttgactgcgagagtgacggctcgagcaggtacgaaagtaggtcttagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggaagattgagaggggctgctcctagtacgagaggaccggagtggacgaatcactggtgttcgggttgtcatgccaatggcattgcccggtagctaaattcggaagagataaccgctgaaagcatctaagcgggaaacttgcctcgagatgagtcttccctggggcttaaagccccctgaaggaacgttaaagactatgacgttgataggctgggtgtgtaagtgcagcgatgtattgagctaaccagtactaatgatccgtgaggcttaaccttacaacaccgaaggtgttttgaattgagagagattttcagcgtcgttccgagattggattgactggcgtcacaagcgttgtttgtgtgcgggttaattaaaacagaatttgcctggcggccatagcgcggtggtcccacctgatcccatgccgaactcagaagtgaaacgccgtagcgccgatggtagtgtggggtctccccatgcgagagtaggacactgccaggcatcaaataaagccaagaccccatgcccaaagcgtggggtttttgctgtgcgcgaaacacaaaaattacgcgttgtaatgatgaccccatgccaaaagcgtggggtttttgctgtgcgcgaaacacagaaattacacgttgtattgataaccccatgcccaaagcgtgggttttttgctgtgcgcgaaacacagaaattacacgttgtattgataaccccatgcccaaagcgtggggtttttgctgtgcgcgaaacacagaaattgtgcgttgtaatgatgaccccatgccaaaaacgtggggttttgctgtgcgcgaaacacagaaattgcgcgttgtaaaatagccccatgctgggtgatggtgttgattgaagggggaatattattggggattaagtttggggcagtgagacattttcttgatattcaatctgttgggatttccatacggctcaattcgctgcccgataaagactataaccagtaatagcgccagcgatatcccaggtaaaatctttccagctccagccggttcctgcttggcggctgtcgtaccattccttaccagccccaattccaatagaaaataataagccaaaattgcgacttttagcatctgaccaattctgatgttctccgtatgctgtacctgcagcggccagagcagcggaagcaaaaaagtgttgggctttatcttttccagtccagctgtcattcgcgacatgggtacaggcagaagtgagtaagagcaatggggcgataagcaatcggcgaagatagatatgcagccgcatagagtttctcttttagtgggagatgaaaacccgctaattcaccgggttttatctttaagacttatagaatacggctaattaaccgatcaatgcggatcctgcgcaaacggcggataagtttgcgaactttaaccggatattgttggatattctccagctcaaggtagtgtgaaaccactttggtatgagtgcggatacactccagttctttggcccgctgttcatgcatttcatgcttaggatcgtggatcaaaatggcattctccaaatccaagcgccatgcgcgcgggtttaggttattgcccgtgatcaactgccaattgttatctacccacatccctttcaaatgataggtgttgtcgccatctttccataagcgaacaatgagctgcccgttatcaacatacggttgtaagcggctcaggaaacgacgcaggttgatttcgtataaatacggcagtgcaccgataattttaaagggttgatcttcagggatataaaagtcatttgcggttttatcaccaacgataatctcaacctgcttaccttcccgcagcagataaataatattacggactaacagcgcgggcaggttaaagtagggggtgcaaatggtcaggcgttcatcagcggaggccattaagtgatgaatcgttttgtttagtaaactcttcttacctaacccaaccagaggagtgaccgctaactcatcgttatgcgcttgtgccgagaattggtaactggcatcacgcagtgatgagcgaaactggcgggtctcattcttgatctcgggggtggtaggtcggtcattacggtcaaggcgttgaactgctccggcactcagtatccgttgtttcacgtaatcaaccataatggtagcgagtgacggattagtgattagctggtagcgatcataacgatatttatcattctgatagagatagacatcattgatgctggcaccgctataaataacggtgtcgtcaatgataaagccttttaggtgcagtacacccaatgcttcacgcgtattgaccgggacaccgtaaacaggaacagaaatatttggatgtttagccgccatatcgcaataccaatcggcattagtattgacggctgccgcaccaatacggccacgctgagcccggtgccaatctaccagtacatagatctccagttcaggatgcgactgcttggcctgatagagggcattcattacatcacggcctgcgtcatcctgctccagataaagtgccaccagaaaaatacgtttggttgcctgagcgatgagttccaacagagtagagcggaaaaccttggggcaataaagcgtttggacatcatcaactgactgggggagtttgggcagttgtgcaaggtgttgttgatgtttgctacgtttgaattttgacaacatcacagtgcgcttcttctcttgttatttaatggcaaaaccgccatatcaaaaaaacactaatccatagagtcggcgataataccattacttttctggattgtgcgcaagttttgcctgccaatggctgaatcacttagctctgtggcctatatcacgctgattggtgtaacaaagatcaaagtgtcagctccagatttacgatcccatcttctatttgcacatcaatagtaaaaccgagtttttgtgccaaaccaatcataccgcggttatttggcatggtgactgcggtgagccgggatagcccatggctacgggcataacggatcatcttctcaagtaatgccctgcctaagcccagcccttttagatccgagcggaccagtacggcaaattcggcatcaatgttgtcaggatcagaaaatgcccgcgtgacacctatgatctctggcccttcactattttgacgcacagcaacaaaagccatttcccgatcatagtcaatttgtgtcatattcgccaaatcatcatggctgaattcattgatttcactgaagtagcgataataaaggtcttctttagttacttgatcaataaacagttttagcagtggctcatcttccggcagaatcgggcggaataagcactgggagttgtctctgagcgtgaccttttcttccaattcatgcggatacgggcgaattgccagacgagcttgagggtcgccaatgacaggggctaattgcatcgacacatccagcagcgtgaactcactgccggaggccagtaccgggtgaatatccagacgggtgatttcggggcagtcgaggatcaagttggaaacttgtaccagcaagcggcttagccctggaatatccaaaggttgtagtgatccgcggctgcgaattttcccccctttgacggcctgtataatcaggtagcgcgccagcaccatattgagaggcggtagtgcgacagcggcttgtgtctcgtggtgccactcaataccgccttcacctaacatgatcaacgggccgaaaatagcatcttgctccacagcaatacgcaattcttgtgctcctgctcgattcgccatgctttgcaccagcaaaccgtgaattcgtgcttgtggataggtccgctttacccgatcgaggatatcgtctgccgcccgctgcacttcaatggcggtgcgcaaatacaacatgaccccctgaacttccgatttatgcgggatatcaggcgagcgaagtttaattgcgaccggatagcccagtcgttcagcaatatgtacggcttctacactgtcgctagcaatccaggttggcaatgtcctgaggccatacgcttcaagaatgggttgcacttcatgggtatcaagctgggttgccccttcggccaaggcctggcgaattagctgatggacatgggcagtattggcggtcaaacctattggtaatgccggggtctctttcagttgtttctgattacgacgatactccaccatatgcataaaagccgtgatcgcgccttccggggtgcgataggttggaatacccgcttcagtaaacaagcgacgggcatcttgtgatgaatattcaccacaccaattggtgagtaacgtgatgcgtttaccgcgcggatgttggcgaatagctgaaatcaataattcagccgttttgcctcccggtgcggcggcgctgggcgagtggatcaggagcagcgtatcgtaatcactactgtccaatagcggcttgagtgccgctaaatagcgctcagcactggcatcatcccgtaggtctattgggttacgtagcgcaacaaaaggcggcagagcttcactcagtgcggattgcgtggcatccgacaaggttgccaatttaccattacggcggataagttcatccaacgccatcgctgccggtgctgaaccattgctgacaatcaacagccgttcaccgcgcagtgggcgcatatggctgagagtctcaacggcagagaacaattcatgggtatcctgtactcgcagcaacccggcccgctggatagcggcatcataggcggcatccaatccttgctgaccattcaagagctgttgagcgcgctgactgcggccacttttcaccaccaaaaccggtttattgcgtgaagcactgcgggaagcggataagaagcggcgtgcatcgctgatatgttcgatatacagcataatcgcgctggttttgctgtctcgggcaaggaaatcgagtaggtcatcgacatcaatatccaagctgtcgcccagtgcaataaagtaagaaaagccaacttctcgttgctgcgcccaatcaaggatcgtattggctacggctgcagactgggagataaacgccagccgccctttcttgatggggacgggtgaaaagctggcattcagcccttgccacggggccagtaaccccaggctattaggcccgagtagccgcatatggtggcgttgagcgcaggctttcagttctgggaactgctccggtgtagcagacaaaataatggcggctttacagccccggttcccaaggtcttccagtagcgtcagattacggcaatcatgggtgcacaaaatcgctaaatcaggagtgatgggtaggctggcgatattggcgtaagccaagacaccgcacaccgctttgtgattgggcgttaccgggagaatcggtccattgaaaccgccatccagcaagttgcgcatcatcagaaaacccgctcgctcaggtttttcagaagcaccgatcactgcgatagatttcggacgtaacagtgcttctaatccacgttggctcatgtgcaggttcctgttgtttatataaggatagcttctctgactttacgcgttttcttcgtgtcctgctgtgactcgccccactgggtgatgaggttttccggctaaatattgttgacggaagtagtgaaagtgatcgcgtagcccttctgcggcttgtatatcacccgcttggtggagcagcgcggtggcgacttcgacagtacagtgttgttcagggcgctgcgcttcccgtaattgataatcggatagatggctgacctgcaaggacagcaggggtaacccggcaagataggggcttttgcggaacatcttcttggcttcagtccaggtaccgtccagcaaaataaatagcggcggtttatcgctgatgggtaattgattgatcacttgccgttctggctcagcataggcctcaggaaaaaccacataaggttgacgcagagggtcactgatagcggctaatagctcaggatcgacttcggttcgcgcccagagaaaagcgtgtgtatcgggcaggatatccgcgataaggcggccggtattactgggcttgagtggctcggtatcaaacataattaggcaaaaccggctgtttgcctgttgtggcttgatggtatcacacaggcagaaacgctcggccagcaggcagttttggcaacggatggcccggcagccgcgggcacgatacgcacgggtggcggcggctaaacgttgttggcgtaaacgcaggactgcattttccgtcgttatggccgtaggtaaagtatggccagtggtgaatgtgtcagtcacgacggactcctgaaaaatagcgccattctaatatagaatggcccacgccccgacagaaaactggcagggggtggattttatcaatggcctgaacagcccttaaaggcgataaatgcgttaaactcacttatcgggctagtggctctctggctaattgtttggttattttgttaactgtttggctctcttgataattgttcatctaaccaattatcaaagggcgctttgggtacagcgccatttagcatatcgatcattttgccgttgcgatacagcatgatggtcgggatgctacggatgcgaaaacgggtgctgagtgcaggttcggcttcggtgttcactttaacgaaacgaacttttccggcgcgttctgctgcggcctctgcaaagatgggcgcgaagctacggcacggcccacaccaaggcgcccagaaatcgataaccattggcaggtcatcttgcagcagcttatccagtgtttcagcggtggcattaatgacttcgccatcaaataaagagtggctacagcgcccacattttgcgccgtcatcaatacgttcttccggtaggcgattcgtcgccatacaagctgtacataccgtattcatacattagcctttatcatatgttagcctttatcatacattagcctttatttttaagtagatataagagaagccagacagccaagaattcactgaattgtttcgctgttgttatctattatggtgatgaatgagttaagtgccaaaatggtttattcgatgagtacgatagttggtagcttttagtgcttgcttatggctaaccgggcggacatcaggtaatcttcgcgccctgcgcgttggtggagaagacaatgaacgattcatttagtggcaaaaacggcaaagttaaagtgatgtacgtccgtagtgacgaaagcagcgacaaccgtaacagcagtaaccgcgataaccgcaaccgcgataacagtagtcgtgataacagtaatcgtgataataacagccgcggcagaagccagcgtccagcgggtaacggtcgtccgggtgataatgcacgtcagggcgataatacacgtcagggtaatgcaccacgcaataatgactcacgtcgtcctgattctggccgtaatgaacgtgatcgtcctagccgtccggcacgttctgaaggcagtagcccttacgattcaccgtggaaaacggtatctcgtgccccttcggaagagccagagtttgatcatggtggtatcagcggtaaaagccatatcgatcctgcccaattgcgccgtcagcgcgctgaagaaacacgcgtttatggtgagaatgcttgtaaggcgctgtttgaaagccgccctgatgctatcgtccgggcttggtttgtgcaatctgtgaccccgcgttttcgtgaagcgctgaaatggatggcggctaaccgcaaagcttatcatgtggttgaagaggatgagctggcgaaagcttcgggcactgaacaccatggcggggtatgtttcctgattaaaaaacgtcaggggctggatgcagaaacgtatctgcaacagcaaactcaggctaaagattgtgtactggcgctggaagaggtgggtaacccccataatttgggcggcattatgcgtacctgtgcgcatttcggtatcaacggcgtgttgctgcaagacccggcgatgctagaatctggcgcggcagtccgcacggcggaaggcggagcagagcacatcaaggccatcaatgctgatgatttcttatcggtattggataccttccgcaaggcgggttacaccatcgtgaccacctccagccataaaggtgtcagcttatcgaaagccgaactgccagccaaaatggtattggtattagggcaggagagtgatggtttgacggacagtgcctggcagcagggggatctgagtgtctctatcggcggtaccgggcgggtcgaaagcctgaacgtttccgtggcaacgggtatcctgttggcggaatggtggcgtcagaatagcgctcaaggctagaatgatcgaagagtagaacgagcgacgttttagaacggtaaaaataaaagggggcgctgatgagttcagggcccccttttttgttgaccgctatttggctaaaaattgcaggttaatgcaggttaatgcaggttaatgcgcaccgccgccgccgccaccggaggtgaaaggagggcgggcaaaccagatcagggccagcagcattaggaacacccccgccgagagccagaaaatctcattcgcagagataatcagcccctgattggtaatttcacgagccaggtaggccgaagcctgttgctggctcatccccagtttttccaactcctggtaggcctgcgtcgcgttcgggttgtacgggttaacaaactccgtcaactgcgcgtggtgcaacgactctctttgcgtccagagggtggtggtgattgaggtaccaatcgaccctgccagtgttcgcataaagttagacaaactggatgccgcggccattcgctccggtggcaaaccggataacgtaatcgtggtcaatggcatgaagaagcaggcaatggcgaagccttggaagaactgcggccatgctgaggcaccaaaatccatccccggttcgaaggtatatgctcgccagtagaaacacaccgcatacataatgaagctaaatgtcactaactggcgcatatcaattcgatgggcaaaacgaccaattaatggcgacagcagcacgggcagtatacccaccggtgccgatgccaatccggcccaggtggcggtatagccatacacctcctgcaatagctggggcagtaagacaatcgcaccaaagtacaacatataggccaggctgagacacaaacagccaatggtaaagttgcgcgatttaaacagcgacaaatcaatcaccggatgatcgtcggttaactcccagacaatcaggaaggtaatagccacgacagccaccacggtcaggacgataatttctgtcgagttaaaccaatccagctccttgccttgatcaagcatgatttgcaaggcaccaataccgaccaccaataacaccagcccgatggtatcaataggtctgatctctgttttggtctctcgtcctttcagggtactgcccgccagcaggaccaccaccagaccgatagggatattgataaagaagatccagccccagtgatagttatcactgatataaccgccgaggatcggcccaaatatcggggcgacaacaatcgtcatcgaccacaacgccagggccatacttcgcttcgccggcggatagttgttgagtagcaggctttgcgagagtgggatcaatggcccagcgaccagcccctggataacgcggaagaagataagcatccccaagctgtttgacatgccgcatagccatgaggccagcacaaacaagcctgttgaccacaagaacagccgcacttcaccgactcgcttggctagccagccggtgacggggatcgaaattgcattcgccaccccgaatgaggtgattacccacgtcccttgcgagttggacgagcctaaatcacccgcaatcgttgggatggccacgttagcaatggtggagtccagcacctgcatgaaggtcgctaatgaaagcgccaccgtcatccaggcgagtggtgctccttcaagcggtttttgtgccacaatagcctccggtgcacgtaacccgcattggcatgatattaatcggcgtttgcatgaataatatcgctaattatttgattaactggcgcgaaatctaatgacaatgcattggtcatgaacgcgggttctttacgcacgttttgtgccaaaacgtgtccatcggtattggcggtgtcgactttaaccagcgatgacagaccaatacgtaacggatgctccttcagttgtttctcatccaatgcaattcgtactggcaggcgttggaccactttgatccagttaccggtggcattttgcgcgggtagtagcgagaaggcactgccggttcccatatctaaaccgaccactttcccttgataaaccacatcatcaccgtaaaaatcggtcacgatagtcgccggttggccaattcgcatgttcgccaactgagtttctttgaagttagcgtcgatccacagttgatctgccggaaccaccgccattaacggcgtaccactactgatttcagcacccacttgtacactgcgacgcgagacatagccgctaattgggctaactactttggtgcgctgcagggtgagccaggcatcacgcattttagcggccgcctgctcaatcgccggttgtttctccaatggcgtattgaggaccaacgcctgattggcgttatattgctgcactgccatatccaacgacgcttgtgccgcctcaacagcatcacgtgcgtgttgcaattcttcacggccgatgactgcggcagcccccaggaccacccgacgcttcaggtcattttgtgcctggctcaattccgtttttttcagcgcaatattcgcttgatactgtttactgttaataatgagctggtgggtttggcgcacgctatttgccaaggcagttttcgcttgctcaaatgcctgttctgcatcggtggggtcgagtgtcaccagcacatcgccacttttgacgaagtccgtattttcgaaatgaacactgaccacactgccgggaacttgagacataatctggacttggttgcctgaaatataggcattatcagtctcttggtgatggcgtagcaccaggaaccaataaataaggtaagccaccccgatcataataaaaatggccgtcagcaacagcagtacacgtttacgttgctgttttttattctgcggtcgttgtggggcttgggctcccgcactttcactcatggtgttctccacgctctatacccgtcattttgcacgttgtatgagggttgaccgccttcgttcaccccagtcacttgattttcgtcagggcttggggaaccactcaggtgtcgcctttctgcaactcgaattatttagggccgatattattgtattgagccatcatggaaggggctgatagccacctcttgtcattgaaggttctgaacggtgctaattgttgtgactgatttttttattgttgctcatcgtttttaggggataactgggaagcaatattgcctttttattaccgcccattcataaacaaatggcaccaaaaggcgcccattccccgttatgttggaatgacatggtttgttctctggatagaaatagtggaattactgttccgatatttccatctgatctaaacgggttaacaacttacgggtcagcatttcaagctgttgctgctcttgctccgtcagggtcgaccaaagaaaatgcaggcatttatgttgtggcgggagaagttgatgtaaaaactcaatcccagcctcggtgagatgcaaatgtaggcaacggcggtcattatggctttcccgacgctcaatccagcctttcttctctaattcatcagcgatacgcgtcgcattcgtgcgcgaagaacccaacgcggcactcaattctgatggttggatactgcgactctcttgggcgtctagcgtaattaatgccataaacaaggtttcgttaattccttgcgctttcagcattttattgcgattttctagcaatttactgtgcatatgcatactcaagcgggtgagtagaatttcctggtaggggaaatccttctgacgttttgctcgagagttcagcatctgttctatgggggagaatgaactttccattatgaggcgcctcattaatttcaaatggtacagtaacgatagttactaataatgtaaacggtatattacgagaaaaatttagcaattagtgttattcagccaaggtgaatcggtcattggcattactaacagtatggttattgtgctttagttcacagattaagcaacttattatcctaaaatcgttagtaatttgaatgtcaaaccgtaacagagcgcgccaagtagcgtagcgaagataatactgttggttttataaaagcatccgcagatcactaaaaaaccaattaatgtagggagtaatttctgtgggtgatgaataatctccggggtactggaaaccaccaataatgcacagattgaggcgatgccaatgctgtccagcagcagagacattttgccccgcagtaggccagtttgcttacgtgctggcccgaagcgcagaggtaagtagcgaaacaagtaattcaccgttcccaccaccagaccgatcatcagtacatctgtattcatggtgttggctcctgctcgtgatcctcacggtgtttggccacgacagaggcggtgggctgaagcaaagtcgcgagacaaccacccgcaatcccggccaaaatagccactggaattgagaacaataaaacccctaataaggcacctgaaagcgaagcgatcaccgtcaggctgtattggcgtttaaacgaggctaacaaaaaactgaggaataatgcaggcagcataaaggagagggacgcttcaatggcggggtagttctccaacggcccattaccgaacatcgcgccgatggccgttcccaagacccaagataaccacgaggtcactgcgataccgagcatccagttctcgctccagcgccgttgatccttcatcaatttagtggttgcagcggcaaacacttcatcggttaaaccaaaagcccataaggccgtttttttacctgatagttttgccacaatgcggtgtttaagtgccgggccatacaaaatatggcgcacatccattgccatcaccgtcagtgccgatacccacaatgacatcccggcgctcagcagggcggtaatcacaaattggctggcaccagcataaataatgcaggaaaagaaaatgctttccagcggggtaaaacccagttttaccgcactgaggccaaaggcgaaagcgacgggtaaatagccgataacaatgggcaggctatccgtaataccttcaacgaaagtcgcggccgctgaagttgtagaaggaggggctgtggttgggtttggcataaagttagctatagatagattaggttacagggcaaactcatcagttatgtaacattaacagagaggttattgccttaataccctataacctaatttatatctatattgactattagttagctaaccaatggtcgtgatcacactgctttcatcatcacattattctacggtttgattcgcgggttgatcacttcgtttacccacaagccaggtcactatattcaacaggcacaggaccaaccctgcggtggagacgccataccagccagcatgttgataggcggcggctgaaatcagcgaccccagtgctccaccgataaagtaagacgtcatatagcctgcggttaggcggtttcttgcttctggcatcatgcggtacatcacgctctggttggtcacgtgcacagcctgtacggctaaatccagtacgataatcccaataatcagtgcgatgattgagtgttggccgaaggcaatgggcaaccaggatagcaacagtaaaactaatccggcgctggtggtgacacgtgctttacctttatcggccaattgacccgctttggtcgccattaatgcgccagcggcccccactaaaccaaatagcccaatagtggcttcagagtaaccgaatggtggcgcggccagcaggaaggccattgatgtccatagcacactgaaattggcgaatgataatgccccgagtaaagcgcgggtacgcagtacgggggtgtgaataaacagggcgaaaattgaaccgagcaactgaccataatttaaaccggtatgttgtttatagcgtggcaggcagcgccaaaggaccagtgccatgataaacatcaaggcactggcaacccaataaatggtgcgccagccgccgagggttgccagtgcgccagcgacggtccgagccagtaaaatacccaacaacaggccgctcataatgataccgaccactttaccgcgtttttctggtgctgccagtgtcgccgctaaggggaccaacaattgtgcgaccacagagaacaagccggtgagggcggtcccgataatcatcatcgtcagattttgcgacatcgcggtaatcagcatgccgcctgctgccagtaaggtcatgccaacaatcagcccacggcgttcaaacatatcgcccagtgggactaagaacatcagtcctacggcatagcccaattgggcggcggtgacgataaaaccggcctgattgacagagaggctaaagtttgtggcgatagtttccaacaagggctgggcgtagtagttactggcaacagccagccccgtggctaccgacatcaatacgatcagtgccgggcttaaaccaggagtgtcagttttttgcattatgggatgtggtgtctgaatttaggaggaagagagtatttcatattttaggtgttttgcctttggaatttggtggcgaggcattttcgagcgagggccaaaggccccctttggaatgacaaccacgataaccccccattacggcgatcatcattactacaatcatcattactacaatcatcattactacaaatcaccatgactgtaatcaccaccaccaccactactcagcaatcaagctcacatgtgcggccacaatccgccaaccgcacggtaatttaacccatgtttgcatctggcggccgacacgtgtactcccttcgcggtaaaattcagtgctggcaaccgccgtatcctcgccaaaggtggtgatcaccgtattcttcaatttacgatccagccttaccgaaggccggttctgacgaaactctctgatggcatcaataccatacagatcttcccccgcgccaaaacgcactgtacgtttatcgtgccaaaacaacgcatctaataccgcaatatcattgccgattagcgcctgttcataacgataaaacgccgcagtgacttcggccagcaccgctaggtgatcgatacatgcatttttcatctgattattctcatcggagacggttctcgccaaatggctatctttatcaagcacggtcctatcaaataacggacctatcaaatagcggtcctatcaaataacggtcctatcaaataacagtactcaccggcgcgctgaccaacccttgttgctctagcgcataagccgcgcgcaggcataaatcttctcgccatggtggggcaatcaactgaatgccaattggtaagccgcgggtggttttcaagggtacgctcacgactggcagacccaggaaggagattggctgggttaatatgcccatactggcgcggatcggtaggtccatatcattaatcctcatcgtgtcctggccgataagcgtggcactgcatggcgttgctggggcaatcaaaatatcccagtgctcgaacagcggcaaaatgtgttggcgaaaatgatgacggaaacgctgggcctgtacgtaccaagttgccggtagcatggctccggctaataaccgctcccgtgatagggtttcaaaacgttgaggtgatttcctcaaggcgggcagatattgattgccgccctcgctggcactgataataaatgccgctgaccgggctaaatcactctgcggcatctcgacctccgcgttagcctcaagcgcctttgcgaccgccagcactgcggctttggcgtcatcatcactccattgatgaaagtaaccgcccagcaccgcgcttcttaacccttgctgaccacgcgtcagtaaattttggcacggcgtgacgggttgatcggcttgaaaattatcctgagtatcgatgccttgcatcacgtcataaaccaccgccaaatcttgcgtacagcgtgccattgggccgatatggtccagactggcgacaaatgggtgggtgccgcggcgtgacaggcggccaaaggttggtttcagcccaaaaataccacacagtgaggagggaacccggatcgaaccgttagtatcactgccgagagaaaagtgcacgagccctgcggcgaccgctgccgcagatccgccagaagatccccctgcaatgcggttcagatcgtgtggattatgggtggcaccataatggctgttctcggtagtaaaaccgtaggcataggcatccatatttaacatgccggagagcatggctccttggtggctcaggcatgaaatggcccaggcatcctgtttggcgggggcttgatcacaaaataagctggcacctgatagggttgtttctccggcaacatcgaacagattcttgaccgcataagggactgccgccagtgctggcagcggctggcctttggcgcgtagcgtatctagccgacaagcttcgctaagcatacggtcagcggtgatatgggtataagcgttgatgagcggattggcgacggtaatggcgtccaacgtctgctgtgcgatcgcttgtgcggataattcgctcttgtgcagggcttgttggatctcgctgatagtgagtgatgaggcaggcttcataaccggtatacccccgcgatctcttgccgttcatctaaaggtagggccatcagcggtgcggccagagcggcaatgtgttcaaattgttgctgcaatgccgcacggcgctgctcgtctaacgccaccgccagcaatgtttccatctgcaggatataggcgggccaatccatgctgatcattttttctgatgtctttttcatgacaactccggtactgactaagcaagccgtgaaccaaatacaggggggtgagttgggtggctattccctgtgtggctgttatttagcctattacttcctcacctctgcgatccttttcgccgattgacgggggactcattgactgtccgagtgaaagtaagcaagagctgttccagattgtcaggtttcgtgctgagagtgaagaatctcttattatcggttggtgagagtgtgttatgttccgcaaaaatgcctatgctgaaacgagagtttcattagcgtaatgagtttcactggttggggaaagggatgaaacaaatcgacgaacgtttgcggggacattacacacaactcaccccgcaagagcagcgcgttgctgactttatttttgcccattttgatgatctgatcagctacaacagtgccgaactggcgcgattgagtggtgtatccaaggctacggttagccgtctgtttaaacgccttggctacggcagttatcgagaaatgcgcgaagaggtgcgggccttgcgccaaagtggtatgccactaacggataatcgcgatgcggtgcagggcaataccttgctggctcgccactataaacaagaaatggcgaacctggcgcattgggtcaatcagttggatagccagcaacttaccgatgtgatcgatgccatggcacaagcgccgcgtatcttgctattggggctgcgtaacagctatccggtcgcgctgcatttacgccagcagttgttgcaggtacgccagcaggtacatgtgatcccacaggcagggcagacattggctgaggaattggtggacattaccccgcatgatctggtgattgtggtggcatttcgccgtcggcccaaggcgatccgcgaaatcctattacacatgcagggtcagggcgtaccgacattgttgatctgtgagccgcaagctcagtcattgctgtcgctggcccgttggcgcttgaccaccccactggacagtgtttcggcttttgatagctattctgcggcgatgagtttagtgaatttactgagcaatgcattactgcataaaatactggcagaaggccgccagcggatacatcaaattgctaatttgtatgattcgttgggggagttggaatagtgtgaatcagtcgtgtgccggacacgccattctctgcggcacacgctttactctcccgcctatccccacctttcagagcacgtcatcggtgtttgttattagcctgccagtagtcgttttaatgcacctaaatggtgcgtttcaatcttcgtattgcactttatttgttagtccctttatccacttatatgcgctgaaattcacttattccacgtgaatagggggtgtttttgccttgttcctggttggcatggtacttgcaacgataatttcaattctgttttttaagaatccattgtttcattgttgagttatcggagataggctatgaacataaaaaagcggatgttgtggctgtgggcagtactggtattggttcaggcccctgcggtattagcggatcaattagagaaaatacaacagcgtggagtcttgcgtgtggcggtacctcaagattttccgccttttggttcggtaggaaccgatcttcagccacagggctatgatatcgatatggctcagtacctggccgataaaatgaaactaaagttgcaactggtgccagtgaccagtgccaatcgggtgccttatctgcaaaccgataaagtggatttggtgatttccagtctgggtaaaaatccggagcgggaaaaagccatcgcctttagccgtgcttatgcgccgtttttcctcggcgtatttggggctaaagatgatgaactgaagcaaccggaacaactggcgggtaaaaccattggtgtcactcgtggggcggtggaagacatggtattaagcgagatcgcgccgaaagcggctcagatcagacgctatgaggataacaacaccacgctgtcggcctatctatcaggtcaggttaattatctggcaactggcaatctggttatcagcgccttggcccgccagaatcctaagcaggcacccgtcgcaaaatttatgctgaaagattcaccgtgttatatcggcctgcgtcagggagaaccggcactgaaagccaaagtggacgccttgattggtgacgcgttgcaggacaatacgctgaatggcttatcggagaaatggttgaaagcgccgttacctgctgatcttggtgcataacgggagccggctatgacctatcagctaaattttgccgctctgtggccttatttgcccgaattattgtcgggtctgctgaccaccattgagctgacggttatggcgaccatcgggggcattgcattggggatctgcggggctgcgatccgctgtggcaacaccgtgatattgcggcgtctctggggaggttatgtggaaattgtccgtaacaccccgtttgtcgtgcaactatttttcatcgtttttggtctaccggcgctggggctaaagttaagcgccgggcaggccgccctgctggcgatgacaatcaatctgggcgcttacagcacggagattatccgttcgggcattcaggccagtgccaaaggccaatgggaggccgcgcgggttctgggcttgagccgtagccagacctttttccgcgtgatcctgccgccgtcattgcagcggatttatccggcgctggtcagtcaatgcatcattgttatgctcggttcagccgtggtgtcacaagtttcatttgaagaactgaccttcgccgccaatcttattcagtcgcggactttcctcagttttgaggtctatctggtgaccaccttgctgtatttgttgttcgctatcgtgatgcgccagctattgctggcggccgggcgtcgatactttgggagccatgcctcatgacatttactgactgggatatcatccgcaacctgctattggcggcccgctggacgctgttactgtcactcacggccttcttcggtggcacgttggtgacattaccgctaatgcttatgcggttgagccactggcgttgggcggcgcgctttgtccgtttatataccgagctgttccaaggaaccccgttattgatgcagctatttttggcctttttcggtctggcgctgtttggcatcgatgttagcccgtggacagcagcggccatggcactcaccttattcaccagtgcatttttggtggatatctggtgcggcagtatcgccgctttgccgaaaggccagtgggaagcatcacgttgcttggggttgagttttcaccaaacgctctttcgggtgattgccccacaagcgatgcgtatcgcgattgcgccaaccgtagggttttcggtgcaggttatcaaaggcacggcgctggcctccatcattggttttgtcgagctaaccaaagcgggcactatgctgaacaatgtcacttatcagccatttaaagtctttgggctggtcgcgctgggctatttcctgatgtgttatcccctgtcgcgttatagccattatctggagaagaaattccatgccattgatcaccattaatcaggttcaaaaatactatggtaagaaccatgtgcttaaaggcgtggatttggatatcgagattggtgaagtgatttcgatcattggtcgcagtggctcggggaaaagcaccttgttacggtgcatgaacgggctggaagattatcaggacggcagtattaaactgggcggaatgacggtaaccaaccgcgattcgcaagcgcgtgagatcagccgttcagtcggtatggtgttccagaattttaatttattcccccatatgacggcgctggagaatgtgatgctggctccgcggcgagtattgaaaaaaggggccatcgagtgtcgtgaactggcggcacagatgctggagaaggtcgggctggcagatcgggtcgattattacccggcgaatctgtctggcggccagcagcaacgggtcgcgattgcccgcgcattggcgatggaaccgaaagtattactgtgtgatgaaattacttctgcgctggatcccgagctggtgggcgaggtcttgaaagtccttgagcagttagccgcggagggcatgacgctgatcctggtcacccatgaaatgaattttgcccgtgaagtcggtgatcgggtggtatttatgcatcaagggcgggtgtgggagcagggcgagagtcgcgcgctatttgccgatccacagacccgcgaattgaaacagtttatatcgtcagtccgcggtttatctggccctgcctgatggtgatttatataaaggatggagattttttatgtcagagataaaccctaatcccttgttcaggcagataaatccacctgcccgtttattaatggggccgggaccgatcaatgccgatccacgggtattacgggcgatgtccagccagttgatcggccaatatgatccggcgatgaccgattatatgaatcaggtgatggcgttgtatcggggggttttccggacggaaaatcgctggacaatgttgatcgatggaacctcgcgtgcgggcattgaggccgttttactgtcggcgatccgtcccggtgacaaagtgctgatcccggtttttggccgttttggctatttattgtgtgaaattgcccgccgttgccgtgccgaagtgcatattatcgaggtgccgtggggggaggtattcagcccggatagaattgaagatgccatcaagcacattcgcccgcgcctgttactgaccgtgcagggcgatacctctaccacgatgttgcaaccgttagctgagctgggtgatatttgtcgccgccatcaggtgttgttctataccgatgccaccgcgtcactgggtgggaacccattggagacggatgcctgggggttggatgcggtctctgctggattgcaaaagtgccttggcgggccatccggcagttcaccgattaccctgagtccacaattcgccgaacagattcgtcgccgtaaatgtattgagcagggtattcgtacttcagatcatgcggatggcgacgaggagatgatctactccaattactttgatctgggcatgatcatggattattgggggccggaacggctgaatcatcataccgaggccaccagtatgttattcgccgcacgtgaatgcgccagagtgatattagaggaagggctggatcatgggatcgcccgccatgccttacacggtagcgcacttttggccggtattcaggggatggggctttcggtgtttggtgatataaagcatcgtatgaataacgtattgggcgtggtcataccgaaaggtattcccggtgagcaagtccggcaactgctgttgaatgactttggtattgagattggtacctcgttcgggccgttgaatggcaaaatttggcgtatcggcaccatggggtataacgcccgtaaagattgtgtcatgcaaacgctagtggcgctggaggcggtattgaaccgtttagggtttaccacagttcagggcgcagggttacaagccgcatgggatgtctatcaggtggatagtgcgcatcaggtggatagtactcatcaggcggatagtgctcaaaggaatagcgatcatgctcaactgaatggagcgaattgatgagcgtaaccctgccggatatcgaggctgaacaggccgcattacaggtcttggcccgttgtgacgtattggcggcaatcagtgaatcccccgaagggctgactcgggtctatctatctcctgaacatttacgggcaaatcggcaagtcggtgaatggatgcaagcggttggtatgcaggtttggcaggataccgtggggaatatttgtggccgttatgaagggcgacaaccggatgcccccgccatcttgttaggttctcatctggatacggtgcgcaatgcgggccgctatgatggcatgttaggggtattaactgcgctggaggtcgtggggtacttacatcgtcatcagcaacgtttaccggtcgccattgaagtgattggttttgctgatgaagagggaacgcggtttggcatcaccctgcttggcagtaaaggggtgacggggcgttggcctgtggagtggttaaatacgaccgatgccgatggcatcagtgtcgcgcaagcgatggttcgtgccggtttagatccaatggacatcgggcaatctgcgcgtgcagccaatgccttctgcgcctatcttgaactgcatattgagcaggggccgtgtttagaaaacgcgggtttggcgctgggtgtggtgacggatattaatggcgcgcgccgtttacagtgtcagtttaccgggttggcgggccatgcggggaccgtaccgatggggcaacggcaagatgcattggccggtgccgctgaatggatgtgtgccgtagaggcgttgactgcggctcagggagagcatttagtggcgacggtagggacgttgacgtgtctgcccggagcggtgaatgtgatccccggtcaagtgaggctgacactggatattcgcggcccaaatgaccgtggggtgaatgatttattgacccgtctattggctgaggctgaagcgatcgccacgcgtcgtggcataacgtttgccgccgaagggttttaccgtatcaaggcaacggcttgtgatagtgctttgcagcagtgcatcagccagagtatcagccaggtgcagggccgttgtttagcgctgcccagtggcgcgggccatgatgcgatagccatggcggagtgctggccagtcgggatgctatttgtccgctgtaaaggcggcgtcagccatcatccagatgagtccgtcacgagtagtgatgttgcggtggcgattcaggcgtatctggaggctgttcttacgtctccttcgtccccttcgtccttgacgccgcagcggtgttagcggctctcactcgcctgaatcactgactgatgtcagctcatcaggactaatgagcctcatccctgaggctccccccaaaggtaccggcgcgtagggggcgttataacagcttaaaagggtcggcatcgcgccaggcaggaaacccctcacgataatgctgcaacgcctctaaagacaattcagcttctaattgtgccgcctgccccggtgcggcctgggccaaaacttcaccttgcgcatccaaaatcagactattgccctgataatgatggccgttatcatcatcaccaacccggttacaaccggcgacataagcctgattttcaatggcgcgagcggccaataatgtttgccagtgttgagttcgcttggtcggccagttagccacatacagcgctaaatcataatcttgctgattccgtgaccagaccggaaagcgcaggtcataacagatttgagggaaaattcgccagccgcgccactccacgactttacgctcagagcctgcctgatagtgatggtgttcaccggccatgcggaataaatggcgtttatcataatgatggatacgcccacctggttccgctaacaggaaacggttaaccgcgccttctggtgtcatcagagccacactgccgccaatcagcgcattggtgtgggtggcccaatgcactaaccacgcgctaacttccgcttctggcggtgcatgctcagcggcattcatggcaaaaccggtcgtaaacatttccggtaacacaatcacatcacgcgacgataacggcgcaagtagcgtctcaaaatggcgaaagttagcgggtgcatccaaccagaccagcggctgttgcaataacgtcagttttaaagttgacataatctctctgcggcggcgtccagcgtggcatcttgtttggcgaagcacagccggatcaatttatgggggaacggagcttcacaaaataccgataacggtattgcagcaacgcccacgtgctcggtgagccattgacagaactcaacatcatcaagatctgaaatgccgctgtaatccgccaacaggaaataggtcccctcgcttggcagaattttcaggcgactggctgccagtgccttgacgaaacgatcgcggcgggcacggtaaaatttaggcaactgctgccagtgttctggctcggcattaagcatatctgccaatgccagttggaccggtgtgcagacggagaaggtcaggtactggtgaattttgcgcacttcggcgctgatggcggcgggtgcgatgcaataacccactttccagcccgtcatatgaaaggttttgccgaacgaagaaacggcaatcgctcgctgacgcagttgcggatgggccaacacactggcatgacctgaacggctaaagcagatgtgctcgtaaacttcatcactcaaaacataaatattgcgttctgcaatgacctgccaaagctgttcaaaatcttctgcacaccaaacggtagccgacgggttatggggggtattaacgataaccagacgggtgcgttcagagagcagacgggtaaattcagcccaatcagtggtaaaagcagggggttttagtgtgatccgcttgagcacgccacccgccagtttgactgccggtgcatagctgtcgtagctggggtcaaagcagatcacttcatcaccaggacgaacgagggcggtgatggcagcaaatagtgcttcgctggccccggtggtcacggtcacttcgtgctcggcatcgggccgccacccgtagagattggccgttttttccgcgatagcatgacgcagtggtgcgacgccgatcatcggcgcatattggtttgcgccttggtcgacatgataggctagccgctgcttcaggtaatccggcccatcaaaatcagggaagccctgtgacaaattgatcgcttggtgcttttgggccaatgcactcatttgcgtgaagatggtggtgccttgcgcaggcaatttactgtctggaataaaagataaagtgctcatggcggatgaagactcttggtgctgtatgttgccgtaaatataacacgatgttaagatttggcaatcaagacgcttagatgtttaaacggctaaaacagcacaaatactggcagtacaaacaccacaacagggatatgcaatgaccgaaaatagacaacttggcgcgctgttagccgcctgccactggatcggcgaaaagggctggtgcccggcgactggcggtaatatgtccctgaggctggatttggcccactgtttaatcactgaatctggtaaagataaaggcagcctggccgcagaagatttcctgctggtagaaaccgccaataaccatgtgccgagtggccgcacgccgtcggcagagaccggcctgcataccttgctgtatcgtctgtatcctgaaatccaggcggtgctacacacacactcggtgaatgccacggtgctgtcacgggttgagcgcagtaatgcgttagtgttgcaaggctatgagatgcaaaagtcgttgtcaggtcagcgaagccatctggacgcggtggtgatccccatttttgataacgaccaggatattcctgtgttggcgcagcgggtggcggcttatgctgataaccgcccgctacagtatggatttttggtgcgtggtcatggtttgtactgttggggtaatagcgtggttgaagcccgtcgccatctggaagggctggagtttttgttccagtgcgagctacaacgccgtttatttgatgtgaattctaacgttgatgtaaaacctaacgttgacgtaaatcctaacgtggaggccaaatgattcaggcgattgttaccgatattgaaggcaccaccactgacatccgttttgtccatcaagtgctgtttccttatgcccgtgagcggttgacacctttcttacgtgcgcatcagcaggacgacgatatcactgctctactggtcgatttacgccgcgaaattgctcaaccggatgccgatattgaaacattgattaccgttttgcatggttttatggacgaagaccgcaaatctaccgtattgaaggccattcaaggcattatctggcgcacgggttacttgcaagcggattttcgtggccacgtgtatccggaagttgcccaacaactggcggattggcaccaacaggggctgaagttgtatgtctattcttctggttcagttgcggcacagaagttgttatttggctacagcgatgctggggatttatgcccgctgttcagtggctactttgatacccatgtgggggcaaaacgagacgtgagcgcttatcagaagattgccaaccaactgggtattgcgccgcaggcactgctatttttatccgatattcgccaagaactggatgccgcacagctggctggctggcatacctgccagttgattcgtgatctacccgataatgacagcgctcatccacaagttaatcgttttgatcagattgttttaagtctgtttactgaatgattattttaagtctgtttaccgaatgattatcttaagttcgtttacagaataattgttccaggtcagtttaccgcatgattgtttaggggagttaccgtatgagcggattaacgatttttagcgaccagcagccagaaaaaccgttgtggcagagccataatgctgaagaaattcaacagcagttgacggctatcggggtgcgctttgagcgctggcaggcagattgtgaactgggtgagaacccacagccagaggccgttattgcggcttatcagcatgagattgatcggctggtggcagaaaatggctataagagctgggatgtgatcagtatgcgccccgataatcctcaacgtgaagcactgcgagagaaatttttatctgagcatacccacggcgaagatgaagtgcgtttttttgttgaaggtagcgggctgttctgtttgcatctaaacgagaaggtttaccagattctgtgcgaaaaaaatgatctgttatccgtcccggcggatatccctcattggttcgatatggggtcggcacccaatttcacggctatccgcgtgttcgataacccggaaggctggatagcacgttctaccggcgataatattgccgacggctatcctcgcctcgcctaaactaagaaatattaagtatcgggtattgattgctagcggtgaggctggaaaaagcctgccgcgacctgttcaggtgtgatcactccgctatctaacacccaaccactgatcaatgccgcaggggtgacatcaaaggctgggttgtacaccgccgtgtcttttggtgcccactggcaatgaccaaatccgccagagacaccggtcacctcactggcagcacgttgttcaatcgggatcgctgctccatcagggcaatctggatcgtgggtggtgtgcggtgcggcaacatagaacggaattcggtgataatgcgccaataccgccaggctgtaggtgccaattttgttcgccacatcaccgttggcagcaatgcgatcagcgccgacccagatagcatccacttggccatgagccatcaggctggcggccatcgaatcgcaaatcaattgatagggaatccccaattcacctaactcccaggcggttaaacgcccaccttgtaataagggccgggtttcatcaacccaaacctgtcggaggttgccctgctgatgggcgcgcagtaagacgccaatcgcggtgccgatcccggcagtggccagcccgccagtattgcaatgggtcaataggttgctaccgggtttaaccagtgccgccccatgctgggcaatacgctcacacaactcacggtcttcatcgactaatcgtagcgcttcagcggccatcgccgtaacccaattgggctgtaataacgcttgctgcatccgtgccagattattcatgaggttaacggcagtcgggcgtgactcacgcaaggcaatcaatgcttgctcaagtaaagcctgcgataaaccacgttcagccagtagcgccaagagcaggctggctgacaagccaataagtggcgcaccacgaacccgcagcgcctgaatatgttcaatcaacgaggcgacggtatcggctagtagccactcttgacgctgcggcagtgcttgctggtcaaggatccaaagctgaccattgacaatttttaagctggtggtctgtaagtcgagggtgttaagcgtctgcatagtcagttaaatccatgttgcgttattgcatctggtttcttattctgccaacatgttttacggatgtatagacgtccatatgtttttacgcctaaatacaaagtattttatgatttaacaggaaataatttcacggctaaggaagtggttggcggtgagtgaatctgaatcaggtaaagaacaacgaggttgaatatgtcgcgctaccatacgtttactgctgcggatgcggttgaatatgcacgccaatttggtcaggtggccgatccacaggccttggtgacggctgatgaaattggggatggaaacctcaatttggtgtttaaaattcgtgatacagcaggaataagccgggtgattgttaaacaggctctgccttatgtgcgttgtgtgggggagtcctggccgttaacgttggatcgcgcgcgcattgaggcggaaacattgctgacacacagccaattctgcccgcaacatacggtgaaggtgctgcaccatgatgcggaattggcggtgatggtgcaggaagatttgtctgatcaccatatttggcgtcacgagttgattcagggaaattattacccacaggcagcagaacaactgggtgaatatttagcgcagacgttattccatacctctgatttctaccagtctgcgcaagcgaaaaaagcggcggtgagccgttataccaacccggaattatgccaaatcaccgaagatctgttctttaccgacccctatattgatcacgaacgtaataattttgatccggtacttttgccagaggtgctgtcgttaagacaagataaggcgctcaagttagccgtagcctcactgaaacatcgtttcctgagccaggcagaggcattacttcacggcgatattcacagtggttcaatttttgttgctgatggccgtttgaaaactattgatgctgaatttggtttttatggccctattggttttgatatcggtaccgcgcttgggaatttactgcttaattactgtgggttaccgggattagcaggtccccgtgatgcggcggcggggcgtgaacaacgactgaaagatgtccaaacggtttggcaaacattcgccgcccgttttttggccttaagtcaggaaaaaacacaggatcccgcgttggcgacggaaggttatgctacgcaatttttacagcacgtttggcgggatgctattggttattgtggtagtgagttaattcgccgcaccattggtttagcccacgttgctgatttggattctattgacgatgaagagatgcgccgtgcatgccagcgccacgcattaagtttggggcgcgcactgattttggtcgcgccacatgttgatgatgtggggggggttgttgcccgcatccgccaatccccttcgtccttgacgccgcagcggtgttagcggctctcactcgcctgaatcactgctcatcaggactcattcgtttgctgccttgctgcaacgccaatgacgttggggatccccttttttacttgatgccggagtggtgttagctgcgctcactcacccggatcacttactggagtaagctcaccgggattcgttcactggctgccttgctgcaacgccaatgacgttggggatccccttttttacttgatggtgcagcagtgttagctgcactcactcacccggatcacttaatcgttggcctcaaaattaatagcctcatccctgaggctcagactgctgacaaaccccgatgacgcgatcttgaacggtgaggataggcagaggagtaaagcgtccgcgccaaggatggcgcggctcgagcttacatggatgtatttacggcgtctttacgatctgcctgttctctccgtcgcgggcactttgtcaataacctgagcctcatccctgaggctcagcctacgagctagcataaatgctgttcaaattgctttccgacccatttgtcatttgtggcctccctccctacaacgacaatgaattaggtggtgaaagttacaataaataataagaatcctgcaaacaaatatagattttttatttttctatttaccattagtgtgtttatttttacgcatgatattatctggtctattctataaaatagatattattttattctctatatttgaacttgtctgttatttttatttgctagttagtattgtttattttatctttttttattctcatatccttttttttgttaaaaataaaaagtactggtatgaccacattgttggcttgaggtgataattcacttaattcattcacttacgtgagagttgttttattcattaaacaatgctcttgtaggtgaaaattattacacctttagacttaccatcattttttatgaatttttttatatctatctcaaattgctgtttgccgtaaacctgtgacggcaattagtctaagtttacggtttttttagtgtttatgtgactttttaatgtctgttaataccctgttattttctgtgttgcatatttattgtaaatttacttctgcatttattaattaatgataaccgtatgggccagtgctaaataataatatttattgttatttttactggcattacccctgtttttattaggcgtttctttatgagagattgctattgccatggcatgttatggttcccattaaaattcagtttattagctttattttctctttcttgctcaccattaatcgccacacctcaagtgctaaatgtgccaaacgcgggggcgattagtaatgaaattaggcaaacaacaatagagccattgaacgccccagaggaaacggatatcaagcttcctcaattaaataagcccacgccaccagaagggggactcgcgactgaacgcattaccctgcacagggttagatttgaaggcgatgtctcgttatttcagcctggtattaccgctgacaataaggatttacaggcgctgattaccccttggttaaatcggtcactcacatttaacgatttacaagccatgacttttgccgtgactcgcttctatcggaaaaaagggtgggtcgcagctcaggcaatattaccaccacaaacgattcgggacggtattattgtggtgcgcgttatcgcgggccgattagataagcctcagataaataaccaaagtagtttgaattctcactttatcaccacggtaattgaaagtaatagctgcagtaaaaaaaatgggatctttggtgataaagattgtgccgcgtctcccgttgaattatctcgccttgaacgcacggtgctaattttgaatgaaataccgggcgttgaggcttctttggcattaaaaccgggcactcaatctggaatgactcggatttatgttgatgttacacccggaaaaaaaatgatggcttatcttgcggccgataatcagggaaatgattattccggtcataatcgtttgttaaccggcggtgtgcttaataacctcactggctggggagatcaattacgggcagatttaattttatccagctcggcagatgtctttaatggtttactggattataacttccccattaatagctatggtacccgggctgcacttaattatagctacctggattatacgttaacggggcctttctccgtattagatgcacgtggtcactctactacctggggcatcaatttacgacatccatggatacgcacctctgctgcacgaattgatgttaatgcgggttattatcaggccagaatgcgtgatgcattaattttgttaccagaacaaaaacgtaacctgaatgcgggcgaatttggtatcagtggcacttttactgccttaccccgtggactcagtaatttcaatttactgggcacggcaggggatcttgcactggatgacgaatacagccaaagcataaatacgctgacccatgtgagcggtaattttagccgctttaattatcgcgtcggccatgatcagggcattgggtctcacgtctctttctttaatcaatttaccggtcaaatggccagtaaaaatctggatagctcgcaaaaattactcttgggtgggccactggcggttcgtgcctatggtattggcgacggttctgtcgataaagggacgatttttaccacggaattacgcacacgctggcagcctgattttcctgactgggccggctatgggcatcaaattaccgtagcggcgttttttgaccaagggtggggggcttattatcgccagcctatcgtgggcctctctgaaaataatatcaacatatctggctttggttcctatatcactttcgcacgcccggcagattattttttgaatctgacctgggcacaccgaaccggtcaggcagtgacccgtcatcaagataacgatcagctctggttaagtgcttataagatgttttagtgcttatcggcatatttgtcagatttaatggacgcgcataatgaacagtaaattgtacaaacttattttttgtcgtcggctgggctgcttaattgccgtgggagaatttacccgatcatatggccgagccttttcgtcgaaaggcggtcaagccggcaataatcagcgccgggccgttggtatcttaagccgtctggcgatgatgacgggcttggcgcttgggatattccccttgctggttctggcccatccggtgttaccggttaatggccatgttgtcatcgggcaagggatgttggatcagcaaagcagtacgcttaccgtgacacagcaaacggataagttagcgattaattgggacagttttgatattgcgcacggacacagtgtcatttatgcccagccgggtagccagagcattgcattgaatcaggtgcaggggcagagcgcatcgcaaatttatggccgcttacaggcaaatggtcaggtcttcttgcttaacccgcgcgggatactgtttggtaaagaggcgcaggttaatgtcggtgggttggtggcgagcacgaaatatatgtcaaatccagagtttctgtctggtgactaccgcctgatcgggggggagagtgaaggcaatattattaatcaggcgaatttacgctcggccccagggggatatatcgcactggtgggtaaccggattgataaccagcgttcagggtctatcaccaccccacaagggaacactgtgctggcagtcggtcacagcgtgaccttgaatctggaccatgggaatttattaggggtacaaattcagggggaaaccgttgctgcactgattcaaaatggtgggttaatccaggctgatggcggagtgattcaactgacggctaagggtaaagatatgctgatggatacggtgattgataataccggtatcctgcaagctaaagggttgtcagcgaaaaatggtgctatttatcttgatggcggtggtgagggggttgtcagccagatggggaccatcgatgttaacaatcagcaggggcgtggaggacgtgcggttgttgaagggaaacgtatttatctgaataagaacagtaatattaaagcgaagggcactgcaggcggtggcactgttttagtgggggggggctggcaaggcaaagataatcagatcagaaatgccacggctgtggtgatggataaaggcagtgatattgatgtttcggcatctcgcaacgggccgggaggaagtgcggttttatggtctgaggattacaccggttttcacggtaatatccgagccagaggcgggcctcaatcaggcgatggcggtcaggttgaaacatccagccaacgcaatttacaagcttttgggcaagtggatgccagtgccgttcgtggatccgcaggctattggttattggaccctgcggaggtaacaattgttagcagtggtgctgagagtggtgtaatgactaaagtgggtaatatacccgcagagtttttttctagcgcccatatttttattccaacggccaatattactcagatcctcaatagtagtattaatacccagcttaatagtggcactaatgttacgataaccaccagcaacagtagtttaacggggtgccaatggtgcaatataactgtacaagccgatatcactaaaacggcgggagccgatgcgacgctgacattacaggctgacggtaatattgtagttaataataatattaccgctgatgctggaaaattaaatttaaatttattagcagggaataccactgcggattctgccatcacgctgaataatagcaaggttttattaaatggcggtgattttttagctaaacatgccaatgataataatacggcacgtattggcttactgggcgggcgatatgatgttggcaatttcaccttggatgggaataccgcattagcctcacaagttggggtgaatatcagtaatgcggctaatattagcgtcgcgggcgaaaccgttatctccggtgtgagcagtaacagccgtgggcaagggtggcgtggtattgatatatcaaataattcgatcttaacgggcgtggggaatatgactttctcgataggctctaactccaatgtttcatggatggggtcattcactaatgcaacaattaccagtgataagaatataatattccaagggacggggagttcgtcaggtggagtggactttgttaatagccgtattttgtcaaaatctggccgtgttttatttgatataaatggcaatattgttgttaagaatgtttatgggcttcgggtcaataattcacagatcagtgctaaggatgttaaatttgcagtcaatgtcactggagttgatggttttttactaagagatagtcatattaccgcaacttccggtgatattaatgccaatgctaataccatcaataaaggtatttggatctcaggtaaaaccaatttaaacgccagtggtaatgttaatctgcatggtgtgacgactaattcggcctatgcgggtgctgatgcaataaagatcagcggtaattccagtagtaacaatgtcaatattaccgctggtggtcatatctctctgatcgcggttaatgaagggaaagagattggaagcactgtttctgtagattacgccaatataatagctaagaatggagactttaatttaaatattactggggtgaaagggagtccttttaataacgctacgataactgccaacaatatttcaatgaatggcaatattaccgctaatgatgcggtgttgatgactaatacattcctcacggctaaaggcgatatcaaaactgatttaacctctcccactaaaggtttatggtttaggggaaatggtgggatgaccgcggctaataatatactcttggttgctaacagcacatcgagtggagaagcagtgaaaatcaatgcgtcttcatcgaacaaaatgaatatcactgcaggaaaagatatatctataatagccggtaatagtaaaacagctacgggacctaacattaatattgaaaatgtcaatatagaaaccaataatggaaactttacgactaacggcataacaagtacatggctgtcgggagtgaatgttagcgcgaatggtgttgatataacctctaattctactggcaccggtggcatagtattggataatactaatatcctgacaacagtaggtgatattaatacaatagtaaccaattcttccggcaaaggcatttggattaaatctaactcaacattgaattctaataaagatatcaccttggttggagtatccgccggacagaatgaaggggtcattattcaaggttcttcagatgcttcacgtaacaatatctctgctcaagggaatatcaccttaataggtaaaatgggcaatggctctggtcagcgttcattaatcaatttgggtaatgttagtctaacatcaagcggaagaaatattgatattaatggttcgtcagccggtaccggggatgtttattttaccaatgtagagcttaatgctaccgcaggtaatgtttctatttatgctgaaacgaaaaccgctttatcgacatcattaaatgccgtattaagcttggggggtaataacagtatcaaagctcaaaatggatggcttattggtaaagcatttaatacgacacaaggggcgggtattggttttagagccaatagtagcttatctgttgacggcaatatcattttgaaaggcgagaccgaaggggttggggccacacgcaaagggattgatttctatggcgcgaatacactgaatattattaaaggtagccaattatctctcctcggtgaaaataaaggggctcaagataccgcaggtggtaatggcataagctataccagcccagctaaattaacggttaataataatggttctttaaaaatggaggggcgttcaaccagcggtacgggaattaacttcccaagcagcaataatacgctggtattcaatggtgatggtgacacgctgattaaaggcagcagtgtcgcgggtacgggggccgctatttccggtgttgttaataatagtaccggccccatgacgattgaaggaatcagtaccgatggtgccggtgttcaccttttcagtgcagaacatcgtattgatcgcattaatgtcacagggagttcaactcacgccgaaggtttgcggatcagtggtaatgcagcgattgtcgataccacattgaccggaaagtcgatcaatggcagtggtgtgaagattgattcattgccgggctccagtgttgttacccgttccgtcttggataatgccacgctcaatggcagcagtagcagtgggaaaggggtggaaattaccagtgatatcaatggtattcatcacagttcgattaacggaacggctactggcacgggctacggcattaatattggcgaaaatttaaacgttaccgggaccagtgaagctgacttgttgattctacaaggtgtggcgacaacaggtactggcaccggaataaaactcaatggtaataatgatttaagtaataccagtttaaatagctctgcggttgatggtatcgctttggatatcacgggcccgctagctaaccaagggaatgtgatcctaaacggcacggcttctggttcggggattggtgcgcaggtcaatggttcgctaagtgatagtgtggttaacggtacgtcgacgaatggtattggtgtgcaaattaatggatcgcttgaaaacagccgcatcaacggcatttcggccaatggcagcggggttaaagtcgatggcgagaccacgctggataacgccacgctcaatggcaacagcagcgaaggcaagggcgtggatctggcggccaatctgtccggtaaccatggcagtgcggtgcatggcgacacggtcaatggcaccggcatcgacgtgggtaaagacgtcaccctgagtggtggtggcacggatgaaccgttaacggtcagcggcaatgccagcggtgagaaaggtaccggcgtgcaactgggcggcaataatacccttgataacaccacgctgagcggtaatgccactgacggcaccggcgtggatatcaccggcccgctgaccaatagcggcaataccaccctcggcggtaaagctgaaaaaggcgatggcgtgcaactcgatggcgcgattaccggcggcacggtcaacggcacttccgacagcggcgcagggattaaagtggatggcgagaccacgctggataacgccacgctcaatggcaacagcagcgaaggcaagggcgtggatctggcggccaatctgtccggtaaccatggcagtgcggtgcatggcgacacggtcaatggcaccggcatcgacgtgggtaaagacgtcactctgagtggcggtggtacggatgaaccgttaacggtcagcggtaatgccagcggtgagaaaggcaccggcgtgcaactgggcggcaataataccctcgataacaccacgctgagcggtaatgccactgacggccatggggtagagattaacagccgattaatcaataacggcaatactacgattaatggcagaacgtctgatgatggtcacggcgtacatattaatggggccatcagtggcggcgaaatcaatggtcattcagacaatagccacggtgttttcctcgatgaaagtgcgttacttaatgacatcgttatcggaggagggaccggctcatataaactgccggtgtttatagcattacctgaaaccatcggtgagcacgtgactcttaatggtaaaccgattgataaaacccagccagaaggcagtaaggcacgtgaaggtgataacctgacaaggggtaaatatacacctttgccaccggctactgaccctgaattgcccccagcatcaaccgatgaggagaaaaatacaaaacagacctcgacgctaaccccatctcagaaaagagaggatccagacatgttgataatggcgcgaaaccatatcttgagtacccttgaagggcgtgatttatcttcatctgttgtcactgaatcggagcaaagtgcggcgggcgttaccggaattatggtttgtctccctctgagtgaggcctctgaacatgaaccttgcgatacgtatattttagacaagggacaaccccatctccccatgatggtcaagaagtaaaacacgttatacccgtcatatttcaagctgcatgagcgttggccgccttcctgcaactcgaattattttgggtatattaatttaatactattaatgatacagcggggcttggctaaatagagggcaagccctgagctgatagggagatcgggtaatggcggataaatcagttgaattaacgcccgtggtagaggcacccgttgcgttttcattgccttactttgagtttttggtctgtacccggcgttatgaagatgcgggtagattattgatactgatgttggagaagctagatactcaatatgggcgctgggatgttttttctctgaataaagagccaatacagcaacaagagtattattgtaatcggctagccgccgctatcggatgcttattttctgatcccggatttgtgatttcggaaacaggtttccttcagctaatcaatttccaccgttggattgcgttgatttttgcagcatcgacttttggtcatgctgatcatgtgatcactaaccttaatgaagccggagaagggtgctcgcacccattgcgattcgagcgaaataacttccttaaattttgtgtgatgtatttacccgaatcaggtattccgctgcaaccggatatattatggcaatttaatccgcaggcaacagccgcattatttctggcgttattatctccccgaattttaccgagtgcggcggggcatgaaaagcgtgagactttattagcgtggttacctgaaaaactcttaacactgatcagtcttgaggggttacctgagcgtattttgcatgatgtgtatatgcattgcagttatgccgacatggcgaaaaaacacaccataaagcggagtattaattttcatttacgtaaaaccatgctcaaaaatggattatctgatatgaatgaactgccaccattgcgtagcaaaccattgatgttagtgattttagagtggtttaacagtggtcattctatctatcgaacgcactccagtactctgcgggcggcccgtgatcagttttcgactcatggtgttgcgattgcagaggcaacagatgatattacccgaaaagtatttgatgatttcactgaggttagccgaacgggggcggtcgaaacgattatggcgctggcacaacagttacgcccggatgtcatttattttcccagtgtggggatgttcccgatgacggtggcgttgactaatttacggttggcccccttgcaggtgatggcgttaggccacccggcaaccacccattctgactatattgatgcggtgttggtggaggaagactatttgggcgatatcgcatgcttctccgagaaggtggtttctttacctaaagattgcctaccttatgtgccgccagccaatatcactcaaccggaacccatacagcaatttgttcagcgcgaagcggtacatattgccgtttgtgcttcagcgatgaaaattaaccctcgttttttagctgcctgtgccgaaatcgccttacgatccccgctacctatcatatttcattttctggttggtttttgctggggtataactcatcgggttatggaaaaagcggttaatgagatggtgacttcagccaaagtttatgaacacttaaattatcagaattatttacaggtaattaatcagtgcgatctgtttattaatccgtttcctttcggcaataccaatggcatcgtcgatacggtgcggcaggggttgcctggtgtttgtctgagtggggaggaagtccatgagcatattgatgaagggttatttcgccgtctgggtttggctgaagaactgattacacataatgtggagcaatatattacggcgacggtacggttaattacggatacaaactggcgcaatggtctacgccgtcagttgttacaaattcaacccgataatgtgctgtttaccggtaaacccgagcaattcgggcagatcgttcgtgccttgctggataacggccatcaggatgtgaattagtatgctgaaatggcaggccacaactgcatgtgaggatcccgcggagggggaagaacttcatcgcttggttgccgatatcccgatcggcattttacagcacatcacattgaggcggcagttttggcgaactgcctgcgctatctatttattgggatgtggttttagcttatctgatgttagtaaccgcatgttatgggatgagaatctcatcgataaaaatgtgcgcgccactttacagcgattactcggggcgcagggtttgcgcctattgttgatggggcgcattacgcaatcggaaatcagccaaatattacggcagacggcacttaggctgctctatttcagccactattatgaatcagatgctgtcgccagttatttacaacaggggcagtcgttactctcggcgagcgcccagtgctcaccctgtgagttgttccaagggcgaatttccccaggagaggtcgatgaggtgcaattgacgctattaatggatattgccaaagtgactaaaatctcgctgcgggcggcactgcaccggcatctggttgaaggggctacggaggagtgggtctgttcagtgtataagatgaaccaagaggatttctggcagaacatgcgtaaattacatcgtctaaatgagcgggtagtgcaattactgccgttttatactcgtcagacttcaagttgcatgtgcgtgggctgccctcgctcaccccagccacttactgatgtaagctcctcgtgatgcactgagttgccgccttcctgcaactcaaattattttgggcatattcatcagatgaccagatgaaataatcgctgaattaagtatttttttattaaacataaaactaagcctccttaatgggaggcttggttgattatttcgatactgattataaataagctggatacatcatgcggcttcagtttgctgctgtttagccggttttttgactactgggtttgctgccaaggcgctggcgtcaaactcatccacattaatagaacgcaggcggctgttttctgctttagtcagcaacgcggcctcttcggcgctgattttcccttctgccaaggcgtgtttagctaactgatccaagcgagtaaagggcaggctcttacccgcttctttactcaggcgtttgtgaatcggttctgcggcaatcacatccagtaaggccgcttccaataaccctaccgggttaaattcacttggtgtcaggtactgaccacgaccgatacggctacgggtggctgatggaacttgtagcaattgcgccaactggtgatccagatgatcggacggtgcccgatgtacacggcccaacgggaagaccacgacgcgcatcaatccagcaatcacgctattcgggaagttacgcagcaagtcatccagtgcttgttcggcctgatacagagcatcttgtaccccccaatgtaccaacggcagatcctctttctgacggccttcatcttcatagcgtttcagtgtggcggatgctaaatacagttggctgaggatatcacccaaacgggcagagatacgttcgcgacgttttaggctaccacccagcacgcccattgaaacatcagacagcaaggccaagttagcgctcagacggtttagttgttgataataacgacgggtgctgtctttgactggtgttgcactggtgcggccattggtcaggcccagccagaagctgcgtaccatactactaccgacgtggcccaagtgaccaaacagggctttatcgaaagcggcaacgtcattggattgcgcagccgccatctcatcgagaacaaatggatggcaacggatagcaccctgaccaaagataatcatactgcgggtcagaatatttgcgccttcgacggtgataccgatgggtgcgccctgataaccacgggcgacaaagttagcggggccaaggcagatccctttaccaccggcgatatccatggcatccatcacggcgcgttgaccacggtgtgtacagtgatatttaacaatggcagacaagacggccggtttctcgcccatcataatgccgctggtgattaaagttgcggctgcatccatcacataagtgttaccggcgatccgcgccagtggctcttcaatcccctccatcttaccgatggagattttgaattgacggcgaatataagcgtaagcaccgatccccatcgccacacttttcaggctaccagtggcattggaaggcaaggtgattccacgccccacagacaggcattccaccagcatccgccagccttgaccggccatttgagggccgccgatgatgtaatcaatggggacaaaaatatcgttaccgcgggtagggccattttggaacggtatattgagcgggaagtgacgatgcccgatctctactcctggtgtatgggttgggatcagtgcacaggtaatccccaagtctaccgtatcgcccagtaagtgttcggggtccgataatttgaaggccagccccagaaccgtcgcgatgggggccagcgtaatatagcgcttgttccaggttaggcgcatgccgagaacctgtttaccttgccactcgcccatacagacaataccaacatcagggatcgcaccggcatcagaaccggcttccgggctggttagtgcaaagcaagggatctcgtcaccccgggctaatcttggcagataatgatttttttgctcttcagtgccgtaatgttgcaataattcacctgggccaagggagtttggtacgccaacggtgatggccagaatacctgagaccccggctagtttctgtaacacgcgggcctgagcataagcagaaaattcaagacccccatattctttcttaatgatcatcgcgaagaagcgtttttctttcaggtaatcccataattctggtggcaaatcagccagttcatgggttatctggaagtcattagccatacgacaggcttcttcaaccggcccatcgataaaggcttgctcttcggcggttaattgcggttttggatagttgtgtaattttttccagtcaggagcccctcggaataaatcaccttcccaccaggtagtccctgcatcaatcgcttctttttctgtacgtgacatagcaggcatgacgctacggaaaatccgtaatgctggcgcagagaacagtgacttgcgcagcggcgttaggatcagtggcaacagaataatcaccattggtaataatacccagaatgaccataactgcgaggcgcccaaagcggcggtgtaaaccagaagaattaaactgctgagataaaggttcacccggtgatagaacaacacactaataagaaccagtaaggcaacaatgctaagaactatcataatgaagctcctgagatgtaggaggtctgacctgttgagtgatacatttgttttagttcatctcattctttttatcaataaaattacatgttatttacaactcatctcacaaactggccgcattaaagaataaagccttcatgctaatgcatcacagtgcttctcgctgtttatgctatccggtacactgattgaggaaaaatattgatgctataggacatataaagaggccttcctttatgtaccacgatttaatccgtagtgaattgaacgaagcagcagacacgctggcaaattttctgaaagatgatagcaatattgatgccattcaacgggccgcgatattgctggctgactctttcaaggcgggtggcaaagtattgtcatgtggtaatgggggttcccattgtgatgccatgcattttgccgaagagttgacggggcgttatcgtgaaaaccgccccggttatccagccattgcaatttcggatgtcagccatctgtcatgtgtcagtaatgactttggctacgattatgttttctctcgctatgttgaagcggtgggccgtgagggggatgtgttactgggcatttctacttcaggtaattctggtaatatcattaaggcgattgaggctgctcgtgccaaaggcatgaaagttatcacgctaacggggaaagatggcggtaaaatggccggctctgcggatattgaaatccgtgttcctcatttcggttatgccgatcgtattcaggaaattcatatcaaagtcattcacatcttgattcagttgatcgaaaaagagatggtaaaagcctgatgtgctggggtgatcaaccgcggtattaatcaagttgatcacctcaatcttctgtgaacattccggttacctcataaagcgccaaaagtcatgcctgttttattgctggcctggttggatattagtttactgtttgtctattagatgacggctcgtttatcagagggctggtcatgtttcagataagtcgcggaggttggttatgtgcgaattgcttgggatgagcgcaaatgtgcccacggatatttgctttagctttaccggcctggtgcagcgtggtggggggactggcccgcataaagatggctgggggattactttctatgaaggtaatggctgccgcacgtttaaagaccctcaacccagttttaattcgccgattgcccgcttggtgcaagattacccgataaaatcctgtgcagtggtttcccatatccgtcaagcaaatcggggggaagtcgcgttagaaaatacccatcccttcacccgtgaaatgtgggggcgtaactggacctatgcgcataatggccagcttaaggggtaccgccaattggataccgggacttttcggcccatcggccagaccgatagcgaatatgctttctgctggctactcaatcaattagcaaaacgctaccctcgtacccccggtaactggcctgcggtatttcgctttattgctagtttatccgagcaattacgggccaaaggggtatttaatatgttgctatccgatgggcgttttgtgatggcatattgctcaactaatctctactggataacccgccgtgcgccttttggcaaagccacgttgctggatcaagatgttgagatcgattttcagcagcagaccacacctaaagatgtggtcacggtaattgctacccagccactgaccggtaatgaaacctggcacaaaattgcaccaggtgaatttgctttattctgtcttggtgagcgggtcggttttaattagtgccaattgcgatgttggcgtactagtgagcggcggcgggcttaacacatactgcccgttgctgactgaaacgggcggtggcatccggtttttggcaaaataggtatatcccggttgcagttgacgccagaagttggaataggacgaattacggtggcgttgcatattttgttctgtcatacggaaggggtagatactgatatccactttttcctgaccaaagataaacgcggttctcacgtagttaaatatctcatccatataggcatcggtcattgcataacagccaattgatttacaagcaccgtggatcatcagatatttccctgaatacccttgcgacttatcataatcattaggaaaaccgatattaatggctcgataaaactgactgtcgggttttaaatggcgcgtattaatgctgtaaaagccttctgggcttttgaaatccccttcacggcgtttcggcccaagccctcctgagaattcacaaataggatagctttgcactaaacgatactcgccttgtagcttggcatacaactccaagacacgctcttctttgaaaatctgaatataaaccgatgaccccagtagttgctgttttagctctttggatactgccactggctcactggctgagctggtgaaggatgccgcaggcaagcaaattatcatcgcaaataacagcgcgattttgcccataatgattcccacttaatattgatattaaaaatgccgctaattctacgttatagccgtaggtttcttataggcgcagattatcagtcagaaattttttagcaatatatgttttgtataaaataagcgcaacatcggtaaaaatgaattaataatgcgattttaccgagtatacataaattttggcgataaattatttgtgtttgcttgagctaagtcactgcatttgccagacagtatcagcggaaaatgctaaaatcacccgcagctggtgacctgcttgtgtaatggctgtttcagctattttcaccctcacatattgagttcgggtatcagcattaaatttcagctctctttcagttaaagcgcatgattctctgacaatccagtattgcaccgtcgcttaattgaacagtggaaatacctcatctttacgtagctgtacgcttcagggtttatgtgcagcatttgatatcactaatgaagtcgtttaaacctatgattaaaataaagaaagggctagatcttcccattgctggagcccccgttcagacgatacaagatggtccagcgattcatcatgtggccctgctcggtgaagagtatgttggtatgcgtccttcaatgttggtgcaagaaggcgatcaggttaaaaaaggtcaggcgctgtttgaagacaaaaagaatccgggcgtgttgtttaccgcccctgccagcggcaaaatcagtgctatcaatcgtggtgagcgtcgagtattgcaatcggtggtgattgaagttgaaggtgatgagcaaatccctttcgagcattatgctgctgaggagcttaatcaactgagcgatgagcaggttcaacaccatctgttgacgtccggtttatggactgcgctgcggactcgcccattcagtaaaacaccggttccaggcagccgtccgcgcgctatctttatcagtgcgatggatacccaaccgttggcggcagatccgcaggttattattgccactgaatcagaggcgtttaaccatggcttgaccgtattgacgcggctgacggacggtaaagtacacgtctgccacgcggcagggcaggctgtgactcgtcataccaatacgcaagtgacttacaacgaattctccgggccgcaccctgcgggtctggtggggacacatattcattttcttgagccagtcagccagaccaaaatggtttggcatgtgggctatcaggatgtcattgctatcggtaaattgtttacccgtggtgagttgtgtactgaccgcatcgtcgctttggcgggtccacaggtgaatcaacccattttattgcgtactcgtttaggggccagcttatctgaactgaccgccggtaaactaaaagagggtgataaccgcattatttcaggttcagtcctcagcggtaccgcgttctctgctacccatgggtatctggggcgttttcatcagcaagtctccgttatccgcgaagggcgtgaaaaagagttatttggttgggtgatgccggggcgcgataaatactccattacccgcacgacgctgggccacttcttcaaacgcaaattgtttgctttctcgactgatatgcacggtggtgagcgtgccatggtgccaattggcaactatgagcgggtcatgccactggatatcctggcgacccatctgctacgtgatttattggccggtgataccgacagcgcacaagcactcggttgtttggagttggacgaagaagatctggctttgtgtacttttgtttgtcccggtaagtacgaatacggtccggtactgcgcgacatactgacccagattgagcaggaaggataactgatgggcctgaaaaattttcttgagaaaatcgaacaccactttgaagcgggtgggaaattagaaaagtactatccgctgtacgaagctgccgcaaccattttctacacccaaggtaaagtgacaccaggtgcatcccatgttcgtgatgctatcgatctgaaacggatgatgattctggtgtggttcgccgtattccctgcgatgttctgggggatgtataacgtcggttaccaagctattccggccttaaaccaactttatagtggtgcggaactgcaacaggttattgcgggtgactggcactatcggttagcacaaatgctgggggcatcattgacgccagatgctggctgggcaagtaagatgcttttaggggccgcttatttcctgccaatctatgcggtggtctttttggtcgggggcttttgggaggtggtcttttccatcgtccgtaagcatgagatcaatgaaggcttttttgttacctcgattctgttctccctgattgttccccctacgttgccattatggcaagcggctttggggatctctttcggtgtggttatcggtaaagagatttttggtggtacagggcgtaacttccttaacccggcattggctgggcgcgcttttctgttctttgcctatccggcacagatttccggtgatttagtctggacttccgctgatggcttctctggggccacaccgctgtcacagtggagcgttaatggtagccacagtttggtcaataccgttagcgggcaacctatcacttggatggatgctttcctagggtatatccccggatccattggtgaagtctctacgttaatgatcttgattggtggtgcgattattatttttggtcgtgttgcgtcctggcgaattgttgctggggtaatgattgggatgattgccaccgcttacctgtttaactggatcggttcaacgacaaacccactgtttgccatgccgtggtattggcatttagtcctcggcggttttgctttcggtatgatctttatggcaactgacccggtatcggcatcctttaccaataaagggaaatggtggtacggcggtttgattggtgtgatgtgtatcttaatcagagtggccaatccggcttatccggagggaatgatgctggcgatcctattcgccaacctgtttgcaccactgttcgactatgtggttgttcaggctaacatcaaacggaggaaagcccgtggcgagtgataaaccaagaaataatgacagcattggcaaaacattgctggtggtggtgattttgtgtttggtgtgttcggtggtagtcgccggtgccgccgttggcttgaaagccaagcagcaggaacagcgtctactggacaagcagcgcaacattttagccgtggccggtttactgcaaccgagaatgccagccgaagaggttcagcaggcgtttgcgacacggatagaaccgcgcttgttggatttacaaagtggcgaattcctcaaacaagatcccgctacttttgaccgttctcaggcactgcgtgataaccaaatgagtattgcgttgacacctgcacaagatattgccggtatccgtcgccgggctaatgtggttgaaatctatctggtgcgtggtgatggtgggcagattaacaaagttatcttgccgatctatggatcaggtctgtggtcgatgatgtacgcctttgttgctattgataccgatggtaaaaccgtgcgaggaataacctattacgatcatggggaaacgcccggacttgggggcgaaattgagaaccctatctggcgtaatcaatggatcggtaaacggttatttgatgaccaagggcagcccgctattcgtatcgttaaagggcgtgctcctgccaatgatccccatgcagttgatggcctgtcaggagcaacactgacctccaatggcgtacagaatagctttaatttctggctcggtgaaaacggctttggcccgttcctgaaaaaagtgcgcgaaggagcgttaaaaaatggctgatagcaaagagattaaacgggtcttattaagcccattgtttgataacaacccgattgccttgcaaatccttggggtttgctcagcactggcggtgaccactaagctggagacagcattagtgatgactctggcagtcacgctggtgactgcgttttcgagtttcttcatctcattgattcgaaatcacatcccaaacagcgtaaggattatcgttcagatggtcatcattgcttcgctggtgattgtggtagaccaagtattacgtgcttatgcctatgaaatttccaagcagttgtcggtgttcgttggcttgattattacgaactgtatcgtcatgggccgtgctgaagcttatgcgatgaaatcaccgccaattgaaagttttatggatggtatcggtaatggcctggggtacggcgtaatactggttttggtcggttttgtccgcgaattggttggttcaggcaagctatttggcgtgacggtattggaaacggtgcaaaacggtgggtggtatctacctaacggattattcctgctggcacctagtgcattctttattattggtctgctgatttggggcctacggaccttgaaacctgcgcagattgagaaggagtaattgacgatggaacattatatcagtctgttggtccgcgcagtgtttgtggagaatatggcgttagcgttctttctgggaatgtgtactttcctggccgtctctaaaaaagtgtcaacggcctttggcttaggcattgcggtaacggttgttctgggcatctccgtgccagccaataatttggtttataacctggttctgcgagatggcgcattggttgaaggggttgaccttagcttcctgaatttcattaccttcattggggtcattgccgccattgttcaggtgttggagatgatcctcgatcgttacttccctgcgttatataacgcgctgggtatttttctgccgctaatcaccgtgaactgcgccatctttggtggcgtgtcgtttatggcacagcgtgattacaacttccctgaatccatcgtttatggctttggttctggtatggggtggatgctggcgattgttgcattagcggggatccgcgaaaaaatgaaatatgccaatgtgcctgcgggcttacaggggctagggatcacctttatctcaaccggattgatggcattaggttttatgtctttcgccggtgtgaacctataaaggcaggaataattcatggaaataattctgggcgtagttatgttcaccctcatcgtgctggcactgacggtgatgattttattcgctaaatcaaaattggtgaataccggtgatattacagttgaaattaatgaagacgaagataaaagctttaccgccccggctggggataaattactcaatatgctgtccagccatggcatttttgtgtcgtcagcctgtggtggtggcggttcttgtgggcaatgccgtgtaacaattaaagaaggtggtggggatattctgcccactgagctttcacatatttcaaaacgggaagccaaagaaggttgtcgtctggcttgtcaggtcaatgttaaacagaatctgaaaatagagttgccagaagaaatttttggggtgaaaaaatggacttgtgaagttatctcgaatgataacaaagctacctttatcaaagaactgaagctgaaaatacctgatggggatgtcgtgccattccgcgcgggtggctttatccaaattgaagcggaaccccataccgttaaatacgccgattttgacgtgccaactgagtatcgtggtgattgggataaattcaatctgttccggtttgaatctgtggccacggagccaaccgtgcgggcgtactccatggcaaactacccggaagagcacggtatcatcttacttaacgtgcgaattgccacgccacctccatcggtaccggatgcacctcctgggattatgtcttcttatatctggtcattaaaaccgggtgataaagtggttatctcgggtccattcggcgaattctttgcaaaagataccgatgcggaaatggtcttcattggcggtggggccggcatggcaccaatgcgctcacatatttttgaccaactcaaacggttacactcaaaacgtaaaatcagcttctggtatggtgcgcgttcacggcgtgaaatgttttatgaagaggattttgaccagttacaggctgagaatgataatttccgctggcacgtggcgttgtctgatccgcaacctgaggataactggacaggttataccggctttattcataacgtattgctggagaattacctgaaagatcacccggctccagaggattgtgaattttatatgtgtgggccgccaatgatgaacgctgcagtgatcaagatgctgaaagatcttggtgtagaagacgaaaatattatgcttgatgatttcggtggctgatccggtcatcactcgggaattcacagtggttggggcgattgtgcgcaagtatataacacgttgtttaatgttggtgatagggggcctgctgctgagtggctgtggccctgagcaggtcagccttgaaggcaaaacgatgggaacctcctattctattaagtatgtgagtgattcatcaacggctgccccagagacgttacaacaggaaatagacctcatacttgaagaggttaatgaccagatgtcgacttatcggccacattctgaattgagccgctttaatcaaagccgagaggtgaatcaacctttccctgtatcggcggcgacggccaaagtagtacaagaggctatccgtattaaccgtctgaccgatggtgccttagatgtgactgtggggccgttagtcaatttatggggttttggccctgaagggcgcccggatactgtacctaccgaggatgaaatcactcggcgtcgtgcgtgggtagggattgataagctggcagtggataagaatgcattaataaaacgtgttcctgaactgtatgttgatctctcttctatcgccaaaggctacggcgtcgatgtagtagctgaatatctggaggcgcagaatatcaaggattatatggttgatatcgggggggaagtccgtacccgtggtaacaatggggaaaataaaccttggcgtatcgccattgaaaagccagtcgcgggttctacacaacgtgcccaggaaattattgaaccagggcggatggcggtagccacctctggtgattatcgtaattattttgagcaggacgggatccgttattctcatactattgatcctgataccgggcggcctattaaccaccggttagtctctatcactgttttagacccaagctgtatgactgctgatggcctctctaccgggttaggtgtccttgggccagagcggggaatggcattagccaatttattgggcatcccggtcttgatgataatcaaaacagatgatgggtttgaagagcagtattcagatgcatttaaaccctatctacaagtaaaacattagccaggaggggatatgttgactgtctttatcgcatcctttgtattttttctgttagctatagcgggaatgtcgctaggttatatcgtcaaaaataaaaccatacaaggcagttgcggagggatcggtgcactggggatggagaaggtctgtgattgcccagaaccttgtgattcgcgcaaaaagcggttggcgaaagaggctgcacgtaagaagaagctagatcagtttcgcattctataaaaatatctttggccttggcgctgtagggggagctactacatatgttcgctcacccgaatcacttatcggccattgatcttaaaataaatagactcatcgggattcaggatctattttttatctgacaagcaaagcccccgaacgacgcatcattgttcgggggctttgttgtttaattattgtctttttaacgcttttgattaaacaagctactcctcattagccttaattttagcgcctatttttacttcacattttcactcttactgattatttctttaaactgtgctggtgagtccaccatgacaccatttgcctgtaattccttggcttttttataatcatcttgggtattgataccgaaaagaataatgtgtgcattggcattcttccgaaaacaatccatggcctctttatcccaacttaatattgcgctagaacgcccttcacccaaggtgtatttttctacaacttcaactttacgatggagttccaatccataccaacgttctttattatctgttggtaactcacattgatgatccatagtgatattggctaatactgttctggtggtatctcggctttcaaagcgttgaaccttatgagagggatcactgcttttatttactgtatccaacgcattcagataatcgtcattggtggagtaaacgcgggttcgtatcaggcgattcttctcacccttagaggttgccagcagcgttttttgtagtgcttttgccaaaacaatagggtcggcatcaggggatttaatatcgaggtagaagattgtatctggatatttttttagtacgtcatcaagtgtgggaataccgaagagagagcctgctgagggcttgatatcatgcttcttgttataggcaatactcgcatcgatttctgccaattggcttgcagtataagcggagactgcccctgattcattggttaattccttaagatcagaggggcgatacaatacaggaatattgtctttagaaagttgtaatgtaatccagatagcgtcagcgccatttgccaatgctttactaatggcaggaaaggtattttcaggtgcatcggcagtacctgcgcgatgtgcaataatttgtggtgctggaagaggggacgagtgagcgatagctgtaaatgttgacgataaaagtagggtagtcattatataatttcgcataatatgaaattccgattcatttttaatgataaatcttagaggtgagtgttaatcatatagataacgcttttcagctttgtcgaatttaatgattttttattaaagataaatgaaagagtgttaaaaaaaggaataaaagaattcaatatggttatttgcataatttcatggtgtttcgattaggacaattactaccgctctccttgatttgaaacctaaaattttttttgatgattcacttcagtgggttctgctccttgcatgaactcatcggtacgactatagattaggataatcttgaatccttttactttaactgtatacttatacagttgtttgttgggcgggggatttcatgcgaaaaattattcatgtcgatatggattgcttcttcgcggcagtagaaatgcgcgacgaccctcgcctgcgtgatatcccccttgcgattggtggcagtaaggagcggcgtggcgtgatcagtaccgctaattatcccgctcggcgttatggtgttcgcagcgctatgccaacggcgatggcgtttaaactctgcccacagttaacattgctgcctggtagaatggcggcttataaagaggcctcgcagcatattcgcgaaatttttgcccgttataccccattgattgaaccactgtcattggatgaggcctatttggatgtttctgatagcttggcgtgcggtggctctgcaacattaatagctcaagagatccgccagtctatcgctagtgagctgaacctgacagcctccgcggggattgccccgataaaatttcttgccaaaatcgcctcagagctgaataaacccaatggccagtatgtgattacaccgaatcagatccagcccttcctacaggatttaccgctgagtaaaattcccggtgttggtgccgtcaccgccaaacgtttacaggcgctggggttggtaacctgtggcgagatacaaaagtatccgttggcagaattgttaaaacattttggtaagtttggccgcgtattgtgggagcgtagtcacggtattgatgaacgtgaaatatccccagatcgtctacgtaaatccgttggtgtggagaaaacactggccgaggatatttatgactgggaaagttgtgaggcgttgatcgaagaactttatcttgaactggaaactcgtttacgtaaggtaaagccggacctacacattgcccggcagggcgttaagctaaaatttcatgattttcagcagaccacgcaagaacacacatggccagtattgaataaagcagatttactgcaaattgcccacgccgcatggaatgaacggcgggccgagcggggagtccgtttggtcgggctgcatgttacgttgctggatccacaacttgagcggcaattattgcttgattggggctagctatcgcacggtgtaaataacacccacttgcccgaatcactggtgtgtgtcagttcatcgggcttggcttgtaacggtaattattttggctattaaagcccgcttaaatacggttatgtacgttcaggtatcgctttcagcagggcggttaataactgccaatattgaccaacgctctcaatatgaacttgttcatctggtgaatgcgggccggtcatggttggcccaatcgacaccatgtccatgttaggatagggttttttgaacaaaccacattccagaccggcatggataaccatgatgttaggcgttttgttgaacagtttttggtaggtttcccgtaccagtgccatgaccggtgacgttggatccggttgccagccaggatagccgccgcttggcgatgttttggcacccgctaattcaccaattgcggtcagcatactggctacgtaatctttaccgctgtcgatcagggaacgaatcaggcagacaatttctgcttcatgctcattcatcgtaacaacacccacgttaagtgaggtttctacgacacctttaaccgcatcactcatgcggatcacaccatttggcgtggcattcagtaatgcgacaaaacgctgttgagtctctttagtcagtgctttcgtctcggtagagacgggttcgagtactagggtcagatttttttcgaccgcgatcaactcgtctttcaacgttgccaggtaattctggctcaggtttttcagctgttctactttgtctgcggcaacagccagtgttacgtgaccttcccgtggaattgcgttacgtaaagtaccgccattcagatccagcacccgcagatctaaatcttttgcttgttcaaacaggaagcgggccagcagtttgttggcgttacctaaacctaaatggatatccgcacctgagtggccgccttttaggcctttgatcgtcaattttagtgtttgatagcccgcagggatagcttcccgctgtagcggcatggtggtgatgaaatcaataccaccagcacagcccatgtagatttcgccttcctgctcagaatcggtattgatcagaatatcggctttcagccaattaggttgcaggccgaaggcaccatccataccggcttcttcggtcatggttaacaacacttctagtggcccatgctcaacgcgatcatcagataacactgccagagcggatgccataccaataccattatctgcgcctaatgtggtaccacgggctttcacccattcgccgtcgatataaggctggataggatctttggtaaagtcatgtaccgtgtcattatttttctgtggcaccatatctaaatgcgcttgcagtgcaacaggcttgcggttttccatccctttagtggcaggtttacgcagcaggatattaccgacctgatcacgctcggcgtgcaggcctttctctttggcccaggtaacaatatattgtgccagcgcttcttcatggtaagagggatgtgggatagaacaaatttttgcaaaaatatcccacaacggctgaggcgaaagttgagacagttcagacactgtaagtctcctgtgatggggtgtaattaattgatgtataaagatttaatgagatggaatgttaaatctttattttaacttacttggcataactggcttgaattataacacactcagctaatgattttaggttgcttctgctatgagggctaagcccgatactcaaggttatcaataccacaactcggaaaaatgtgcggtttgatgtgaacagaaaaaagctcagtgagttggacgtgcgagagcggcgagcaatatggaaatgaaaagtaagaaggaaatgaaaagtcagaaggggagtcttgcatcaatattaatcaggtctgccctttaccagaagtgaaaacaatgagttaacatcattgggctacgcatgatttattaggaggagagagcatatattgaccttgagcgtagagtatcggcagagttagatgtgaaaaattttatattattcataatgatgcagaaaatccattatgccatttaccttttatgacatagcggaagttagaaaatgaaattgaataatttatatttacgatttaatgtttatgaagaataaatagggattataaaaacagtagtatatgaatggttaatttcattgtatttattgtttatttcatgggcttggtctcgggtaattaactcttttaatgcattaaatgaggtttttacttgaggctgtagcccattttttatttaaatcatccattgttactcctctctgtttataatcagtacatgtgcatttagcactgcaccgcgttgatatgtttatctaataaaatttaatctattgatgttgttttattttatctaaggacatgcatagcctatctaatgcttaatacgaaacaacgtatatatttcatctgttattaactaaattaatattgccattgaaatttaatataacttggttgtgcgagatgattacagtgcctccataactgtggttcggcaacgtttatctcgttaaaagcaacagaacgtgtcgccttttcaaatttctattcaacagtggggctggctgtcagatagtctatgttatttaataaccaaaggtttcaataagaaaagggctttgaaaagtacagtattcatctccataccgcaactcaactcatatacctattgctatctttagctataggctgattttttgattgaaaagtcacttctcatctcttgttttcatttctcacctatttttttaatgggctttatcgctcgaatctcgatagccattgcttgattgatggtagcggcttaaccccccctaggttatggatatgatacaaccaagctcatgtatcgtggttgtattgtaaaagaccagattaggttttttcaaacctataagagaaagtcttagtttggaatttaaagccatcatcacctttttttagtgacttttttcttatggataatcccttgatttagtcagtacataatcattaaaacaaaagtcttctagtcgatgttagtagaaaattttgttctgtcaaaagcaaaaacacaagagtaatgaattattcattgcggaaaaataagaattaaatcctttatttttgtgtcggcatggatgaaggggctgtatttatattgaatatcaatatttacaatcgaaaaataacatataaatagcataataaatcgttattatttatctttaattggcattttattgcgtcactctcttctttttttaggttggctgagtattttcattgccatttttgataagttacatgttaaaaattgcaatgttaataagttcaatattatgatttatataataattgtcctatcctgcttgctcagtagagtaagcgtaaaccttacatttttaaattgggggtgagtaattgcttttactatctaaaagtttaaggtatttcattattaccgcacaaaaagaatccattacgctggccgcagataaactgtgtatcaccgcgtcccctctcagccgaaatataaaggagcttgaaatgaagttgggttgtgaactttttactcgaaccagtaaagggattttactgacatcgagtgggcattttttatacgataaaataatccctgtatataacgaaataattgaacttgaaaaggagttaatcagtaatcataaattaaatgttatttcagaagaaaaaagattggagttaaatatagggaccgatattttccattatgctcatttgttaccgattgctaaggctcggttttttaatgaagaaaatgttaatttttctctagaagttagtactagccaagatattagccagatgctgagagagaatatatatcaagtgtttttctctcaaagagttttaccaaaggagcatggcattatacatcgtaaattaagtgatgaatttatgatgattgcattgcaggatgatatgtatagggatgatatgagccaagaggatattatctcttcttaccctctagtccaatatccaagacaaaacatcagtagtgtagttgatgagttaactaactatttaattagtagaaaattgaacccgataaggatcacattacctaacgtaaatgatcatctatcaataataaatcaaggaggcgcgatagggatattgccatcatcagttaaaaaattaatcaatatgcataattataatattaagctgattccattcgttcataaaggagagaaattaaaagtaaaaagtaacgcttactatttatgtgataataaagatgtctttgaagaaaatatactcccattgttgggtgatagtcatctctgaattatagtaaacctctaatttttaatgaataatgatattttattatgatttatatgttctgctaggtgttctatggaaagagccagcataaaattataaagataatggactagaggacgtttacctttataagaatgattggatctattttattcgactggtttttgatcaaactgtgctatttttatccagatgaaatgaaggacgtcagctttcatcggtggtgtccttacaacattttattttatgtactgtcactgattttatcgtaatacgatgagaggtgagttaactatgatggaaaatattagacaatataaatggtagatggatttattggatagtttaacaaggtgattacgttaggatgttaagggatggaagtatttttgacttttagcattctatttctgaattaaaaaacgggtattatagaataatacccgctgatagagacgattagtgatgtgttcttactgtccgcaaccatggacgagaatcttctgacaacgtagcggcagcggcacttcctggagcgtatggccagttattgctctgtatataatctggtatagtttgagcacaccagccggtgaatgggaacggcttacaggtccaggcttggccatccaaacctattactgttgtgccttctccataagtcgtaaccttgttacggtcccacagtgggtgctcttgttcaattccgcctgatggcaagatattgatagttttttcagctctgctttgtacgccttgattgttggtgacggttagtgtcacttttccggctaaaggttgctgagtagcgacagcccttacagtgacattttgagttgtcgcaacttttggttcaaagtgctggaactcccattggtagctcgctatctgccctgtagatgcgctggcagaaagcgtgatcgtttcattatcttgtacactacttggcgcggtaatctgcgctactggcggctgtggctgttcaggttcaggagttccactgatgagactcatcgcgctactgaagcctgtttgtagccacacaatgtttgttgcaatattagccgtattgtagacaatatcattgccagagcgtacgccgatcctgacatattgtgggtaggtattattcagtttatcagccagttgttttgaccagactgtttgtgcctgattctgtgcggtgatcggaagataaacatccacaacttccacacctttagcgctccctcccatcacacggaaacgaatttggtcattaatggctggcgtgaaaccttgtacgataaattggctgttatttacccatgggaagcttggtgtgctcccttcgctgatgttgacatcgctgcagttgaagaagccttcgttgcccgcgtcctcacgttgccagtaactgtaaatgatggcatccccagtgtggccgtttaacggaacattcagaaaataaaaactattggtacttggagatagcccggtcccagccgttggggtaggagctttatctgcataaagtagctcaagatcttcccaacgtagtgctttggtcgagtcgtagcttggtttagtaatataaaccttcatataggcagggttatgggccgttgtattttcccaacgaagctgcatgtggccattttcatctggggtaataagtgtttttcgccattttgtggcagggacattgtcgagaccggctttacgtggatcacctcccgcacagagtaaaccattgggaacggcgagttctacagtggcttgtatgcttggattggtcgggtttgctgaaagctcattccattgtgtaaacggcagttgtggattgcttggatcgcctgggttctcaatagcttgtcgacaatctgagttaggaatattcgcagggtctccccagaatccagcttctagctggcactgatattgccgggcgatagggaaacccaccgcgccgtgcgcttctgccttatcgaccggtagcataacaaggagctgtgaggctaatattccccccatgctccacaaaataggttttcgatgtagttgtgcattgaaatgtaatttcattttattatccttttacgatatttatttaatggatggtaatacaattaatctgttgaattgtattttggtgatttttatattgcgcatccctcccgcccggaatgggtttttataagcactaacgaatgtcgagtgatctttattttttatttaacttgggtttttaatttatgccatgcatcatctcctttttttattatcgacgtttttttataaaataggattgtatatacattaagccagtgtctcctaaagaaccaaagattcctgccatagcaaaagatatataggggctgctcccatactcaaagctaattaatcccccaagcatgccggtaaaacccgagacaataacttgtgtcgatattgctgatatcttctctcggaggtttttagattttgtatcttgtagtaataatctaacgacacctccccatgtggcgaaaataccaataacaacccaaattacaacgctatctggttcggggattttgagttgcattctaccctccttgattctttattccgaatgagtgcgttaagtgtttttcaattattagttttactgggtttattgcaaatgcaataattgaatgcagtaatgttaattacagcatgagctgatttatatgagtaagaaaagttatggctcagtatactgatgcaatcaaagttcatgctctcgagtgccatagggaatgggatgctgcgagatgaatttattacgcatttttgcgggcagtcgcgggtaaacagttgttaaaaagcgtactgttagccagcgttatcacggttgccaccgcatgcaatccgacgaattacacggataattgctggtttttatgtcgctggctcactataatctcgcgcaaccttttttcccctttattatggcaagccacacctttactggctgggattacactttatgaacgaaaaatacgtcgttacctgggatatgttgcaaattcacgcccgcaaactggcacagcgtttactgccagccgagcaatggaaaggtatcatcgcggtcagccgtggtgggttagtaccggctggtattctggcgcgtgagttgggtattcgttatgtagacactgtgtgcatatctagctatgaccatgataatcaacgtgatcttaaagtcttaaagcgtgctgaaggtgatggcgagggctttatcgtcattgatgatttggtcgatactggcggtaccgcgacagctatccgcgagatgtatcctaaagcacattttgtgactatttttgctaaacctgctggccgtccgttagttgatgactatgtggtcgatattcctcagaacacgtggattgaacagccatgggatatggcggtgacttttgtcgcgcccctcagcggcaaataatttactgttctttaagcgtccggtgcctgccggacgtttcattttctcttcagtatgcgtacacttgaccccatctgatcagcccttaccgggtctgactcacggcttatggaggctactgttaccatggcacaagccaacctttctgaaattctgttcaaacccaaattcaaacatccagaaacctcaactctcgtacggcgtacccattgcaaccacgtcgtgaatatccattcggcgttggatggtgataccgccaaccattggtatcggatgattaatcgtctgatgtggacttggcgtggcattgatccccttgaaatagaagaggtcttatcgcgtattgcctgttccaaagcggagcacagtaataacgagttattggataccgtggtgggttaccgtaatggtaactggatttatgaatgggccaatcaggggatgatgtggcaacaaaaagcgatggaagaaaccgatccggggagcgcaggtcagttctggctgaatgcggctaatttgtacagcattgccagttacccacatctaaagggcgatgagctgtcggagcaggcagaggtgctgtcaaaccgtgcttatgaagaggcggccaaatatctaccgtacaccttaaaagagctgacgttccccatttcggatggcggttcgctgtcaggtttcttacacatgcctactgttggcagcgcacctttcccaacggtactgatgtgcggtggtctggatacgttacaaagtgattaccaccgcctattccgtgattatctagaacccaagggtatcgcgatgttgaccatcgacctgccatctgtgggggcctcatcccgctggaagctcacgcaagataccagttatctacatcagcaagtgttacaggcgttagcggatgtcccgtgggttgaccatcagcgcgttagtgtgttcggttttcgttttggggctaacgtggccgtacgtttggggtatttagaaccacaaagggtacgtgcagtcgcatgccttgggccgattgttcatcacttgctgtgtaacagcgatagcctacgtaaagtgcctgacatgtatatggatgtcatggctagccggttgggtatggcggattcgacagatgagacgttgaacaccgaaatgaaccgttattcgctgaaaacccaaggtttgctggggcggcgttgtcagacacctatgctggccggtttttgggagaatgaccccttcagtccaaaagaagaagctaaattgatctgctcttcttctgctgacggtaagttgttagctatcccgtctaaaccgctctatgagaatttccatcgtgcattattgcaaaccagcgaatggttagaagataaaatgcgttaatgagttgctaaattttaatagtttgctaaaaaggttcgtctacataaggagatttaagtatgacgttaaccagtgctcatcctaaaagtaagcttatgaaacgttttgcagctttggggccatacctgcgagaagggcagtgccagaacgaccattttttctttgattgtttagctgtatgcatcaatgtgaagcttgccccagagaaacgtgagttctgggggtggtggatagaactggagccatcggctggtcgctttacttatgtttatcaactcggactctttaataaagaaggcaactggaacgcggaaaaaattagcgatcctgaagttcaggataaacttgaaagtacactgcgtagttttcatctgcggctcgaagagatgctagcttccattgacatgaaattagaacctgctgcggattttaacgatcagcctgttaagttatctgcttgataatacgcttacctaggtttgattaggccaattccgtggtcataaactgtccccattaccccctttctgcacaataaagggggtgatttcgtatcaagcctgttggcataatgccttgcgcctgctacaaagacctctagaccatttcttttattcatcccaacggtagaaaaattatgagtggcagccagacattggttgtgaaattggggacgagtgtactgaccgggggttcccgccgtcttaaccgtgcccatattgttgaattggtgcgtcaatgtgcccagcaacacgcaaaaggtcatcgtattgttattgtcacctctggggcgattgctgcgggtcgtgaacatttagggtatccagagttgcccgccactattgcctcgaaacaattgctagccgcggttgggcaaagccggttaattcagctctgggaacaactgttttcaatttatggcattcatatcggccagatgctgctaacccgcgcagatttagaggatcgtgagcgttttcttaatgcccgcgataccatgaatgcgttgcttgataaccgcattgtaccggtgatcaatgagaacgacgccgtcgctactgctgaaatcaaagtgggcgataacgataatctctccgcattggcggccattttggccagtgcagataagctactgttgttgaccgatcaggcggggttgtacaccgctgatccgcgtaacaatccagaagcggagttaattcgcgaagtgcatggcattgatgatgtcctgcgcgggatggccggagacagcgtttcggggctcgggacggggggcatggcgactaaactgcaagcggcggatgtcgcgtgccgtgcgggtattgatgtggtgattgccgcaggtagccaggtgggtgtgattgccgatgtgattgacggtacgccagtcggtacccgtttccactcattggaaacaccattagaaaaccgtaaacgttggatttttggtgcgccaccggcaggtgaaatcacagtggacgacggtgctgtatttgcgatcatggaacggggcagttcgctgctgccaaaaggcattcgcagcgttaaaggggacttctcccgtggtgaagtgatccgtatccgtaatctcaatgggcgggatttagcacacggtgtttcacgctataacagtgatgcattgcgcatgttagcggggcatcactcgcaacaaatcagtgaaatcctcggatatgaatacggcccggtggctgttcatcgtgatgatatgattgtcagctaaggagcaaacatgaacctgttagaacatatgggaaaagcggccaaacaggcttcctggcaattggcgatgttgagtacggccaaaaaaaatcaggcactggcggtcatagctaacctattagaatcagagagccaaactattttgcaggccaatgagcgggatatggctgcagcacgcgagagtggcatgagcgaggcgctactggatcgcctgttattgacgcccgcccgcttagccgccattgctaatgatgtacgtcaggtatgccgcctaaacgatcctgtagggcgtgttattgatggcagtttgctggacagtggtttaaaactggaacgtcgacgtgtcccgctgggggtgattggtgtcatttatgaagctcgccctaatgttactatcgatgtcgctagcctgtgtctgaaaactggcaatgcggtgattttgcgcggtggtaaagaaacgcatcataccaatcaggcgacagtaaatgttattcagcgggcgctggagcaatgtggtctaccggccgctgcagttcaggccattgaaagcccagaccgccaactggtgaatgaactgttacgtctggatcgctatgtggatatgttgattccacgcggcggcgcaagcttacataaattgtgccgagagcaatcgaccatcccggttattaccgggggtattggtgtttgccatacctttgttgatgaaaacgcggattttgaaaaagccttattggtgatcgaaaacgcgaagatacaacggccaagtgcttgtaactcactggagacgttgctggttcatcaggcggttgccaaaactttcctgccgctattaagtgccagaatgcacgcgtttggcgtgacattgcatgccagtccgctggcgatgccctatctggccgatggaaaagccaaagttgtggcagtagaagccgctgattacgatgatgaatggctatcactggatctaaatgtggatatcgttactgatattgatgccgccattgaccatatccgtgagcatggcactagccactctgatgctatcctgacccgttccctgagccatgctgagtattttgtccgcgctgtcgattcatcggctgtttatgttaacgcgagcactcggttcaccgatggcggtcagtttggtttgggtgcagaagtggcagtgagcacacaaaaactccatgcccgaggccctatgggactggatgcgctgacgacgtataaatggataggttacggcgacgatttagttcgtagctgatttattttttagtaggtttattggcaacaggtttattcttaaccggttgatcaatagctgattgattaaaaatcgctagtaaagcgacatgtggcaatttgccaatgtcgcttttttttcaaatcaaacctgacccagccaacggttattctgcaaaaaatattatcctgcataaacgttctccagtccaaaatatggcccatccggactatttcctcccgatagtaaaacatttaagtaattctgttagttgccgataacctctttgttatttatacatttttgatgataatctgagcagatagactgataaattaagaatagggaatggggacagtgagcgaaacgtctaaagagcaatttgttaaaaaaaataaactagcgatctgtgcaattcttcgggatttacagaagaacgatactgccgtgatggttacccatgctcgaggacaatttattagccgtattctggatatacagcctgagactaatcagtttattttcgatttcggcagtgtagaaaacgaaaatgttttggctcttggtgcggagcaactcacgattattgttgaacctacgggtgccaaaattgaattcacctgtaacaagctgaaacatgtcgaatatttgtcactacccgccttcagttctgccatcccggaacagctctatttcattcagagacgggaatattttcgtgtcagtattccgcaatggccagcttattattgtagtgggaaattccctgacggcactcagtataaatatacattggccgacatctccttgggtggaatgggtttatatgccatgaaaggtagcgaatttccgctccagggatgcagtgttctgcgagatgcagcggtagatttatgtggttttggcctctttaaattagatctgcaatttatccgggcgctcgataaacaagtggttaataacaagggcgaaacgctgacagtgcaacgtttgagttttaaattcttgcgcttaagtcctattcaagagaaaggcttacagcgagccatttttgaactggaaaaacagcaaacagctaaggcgaggaaatttcaggaaggcctgtagcctcactatattctgtagcttcactctatagagtagcggtctgtcgcttgtatgatgcgttttatcattatttacaagcccacagggagcgcctctgaggctaccttgagaagacaaaataaaagctgaaaaatatgttgtattatcatgcaactgccccaatattataaccatcacaaaatatggagggcagtgttatggggatcagtgaagaagagagtatccgccgtctgaccaatgagaaaaatgctgttggtcattcggcgaaatgggtggcaattatttctgctgtctactttattatcatgctgttttacaagcatgaattgggcgtattaacattggctggtgggattttcttagtgtcgttcaccacgtggatgaaaaaacgccaaaaagtaaaatcgtataaaaatcagctacaacagattgaggaagataaaaccgtttaactttgctgatattctcattagcctgcattatttgatgaatgataggcatcatgccgcatggatggctcgcccgataatcagatttccaggtttattccgtttgccattttgcaagcgccacctgaatattgcttttatccaaaaaacggtcattgcttcacattctctggtcactggatagcacggtaaaaaatcaaaaccatgtcgtatcctatgatctctccgctcaaatattacaggttgtcatgcaggccgcagcagataaaaaactcactaatattgagatacaacaagggctggctgaatcattgccttttgctgatcaaagctttgatattgttatcagccgttattctgcacaccattggcacgatgttgggaaagctttacgtgaagttaagcgggtattacggcccggtggaaaagtcatcttcatggatgtggtttctcccggacatccggtattggatatctatttgcaaacagtagaagtcttacgtgatacctcgcatgtgcgaaattactctcctggagaatggctatctttatttaccgagggtgggttagtaataaatgaagtaacttctgaccgcttgtatttggagttcagcagttggattgccagaatgcgtacacctgtacattttgctacggctattcgcgagttacaaaagttagcatctgacggtgtcattaatcactatgctattcaggctgatggttcctttaccagcgatatcatgatgattgttgcagtaagagactaataaacaataagtgtggatggtggtaataatatatcaatattcacatttagatttatataaatatatttttattatggataatgaggttatatcctttttattgttgcaccaatgatttattttctttacataacattacgtctccttgcattgctgcatccataatcaatatcactaaagtatttcatataatctctccgtaggcgtctattatgaaataattctttgtgattgtgactaaaattattacgacagcctcattttgtcagcagctttttttatcgagtaagccactatagataaaacatgaggagaggctatctttttaatatcaacgttcaagggacgggcattgggtgaagactgaatgaaaaagtgacaactgatggacctgtcacgatcatcattggcctcggccatgataacgttagccactacaatgctaacatcagcacctatcattagtttctacaatagataaaaaataaatcgataaataaatattttgatacaacactttttggggggatttttagccagtagataagcctgagtaaaccataatgcgtcatcgctaaatctggtttacttacttcatcagcatcaatggttacagagtcaactttttcagtttatctgataaaaataattaattattagaacatcttaatgagaacttaagaaatataaagtgttattgtggtccatctgagtctccgaggagaggttatgctaaacattgtccggcgtaattttaaaagtcagttttcctatttgcagcgttttattgcctcacctcgtaccgttggttcattggtcccctcgtcgccttggttatgtcaggcgatgctaaaccagatagattggacacaaaatcttaatattgctgaattaggtgcggctgatggtgtgctgactaagcgtattctgtcgcatatgtcagctaattcgagcttacaagcgtatgagattcaacctcattttgtacatgcattgcaccagctaaaagatccgcgtttacagatcgcagatcgttctgcggagcagttggatcaagagtacgatgttgttttttgttgtttacctttgctgtctatcccaaccaagatcagtatcagaatattacagcaaactcagcaacgcctacgtgcacgcaatggagtcttagtgctgtttcaatacagccatctatcagagtcattgctatctcgttattttaattggaaaaaaatacgtgtcgtgcgtaattttcctcctgcgctggtttatatttgtcaccccaattaaccgacatatcttgcccactcgatgtggataagagcttcatatcgagctaggtcactacgctgattttatagggtgtattattaattttacgtcactgtaaagttggcactactcttaattatcggtatgatttgtctctgcggcgttgaaccgcgtagtaaacctgttcaaccggccaataataacggtcggttttttgatgtcgaaaatttatcctcagaagttgatacaaaggactttcaagtaatgacacaaactatcttcatggtaggcgcgcgcggtgcgggtaagaccactattgggaaggcattggcgcaggcattggggtatcggtttgttgatacagatctatttatgcaacaaacctcacaaatgaccgtggctgaagttgttgagagtgaaggttgggatggttttcgtctacgtgaaagcatggcactacaggcagtaacggcacctaaaacagtcattgccactggtggtggtgcggtactgtccagtgaaaaccgtgcattcatgcgtgatcatgggcgagttatttatctgcgggcatcagcagccgtattggcaaagcggctagcagaagatcctgaagaggctcagcggccaagtttaaccggtaaacccatcgttgaagaaatgctggatgtgttggctagccgtgaagcattgtatcaggacgtcgcccatcatgtacttgatggaacgcaaactccgtcgctggttgtcgaacaaattttacagatgttgactggtgagatggtcaaataatgaagaaaagggggtttgattggtaatgtgtgtaatgtgtgtaatgtgtgggcgagtctgactgattgctaattaattatgcagtatacaattgtcacctacataattatttggaaacgcgttttttacgttcatcttatgcggcttaaggtaagacaacgcaaggtgggccaatgaaaaccttcaaattatttttccttcaacactcgcattttatgcctgcatttcggtcgatattgatcgcatttttgaaacgatattaatgttttttattttatgttatatcgttaatcagccgccgctttactttttttgtcttaatcatccgctttcgtgcctttgaaaggcattgcacgatacacaaattgtgcgctttctcctcaaccaaggcagtgaatctggttatgatcccatttcgtcataataatcagtgacagaccgtttacagaaattctaatatgaaagctcatttatattaagatgcgggtgcaaagctatgctgaaatttaatgagtattttaccgggaaagtgaaatctattggttttgacagtgacagcattgggccagccagcgttggggtgatggaaaagggagagtacacttttagtacagctaaagcggaggaaatgacagtaatcaccggttctttgaaagtacttataccgggatcgcctgactggcaaacctttatgccgggtgaaaccttctatatcccaggggaaagtgaatttaacctacaagtggctgaagcatcttcatatttgtgcaaatacttgagctaatgaatgtattgagttagcgaatctgtcaccctctctatgccagagggggcgacatatcatctatcctttttacttactctaagctgcatcgtagcgagtgtttttcacttctcactgacccgggtcactgactttagcaggcttatcggatgtgatgttgcccgcctaactgcaatcccgatgactttggttatatttagccgcgctgtcgtgtgctgaaatcagtgttgtgcttcgccgccaagggcctcaatgagattcttaatcaaagcggccagctcactggtcatcagaataaaatcggcatcgaaacgctgtgcaaaatcttcccgatcaatatcttcgttttgatcacgtagcgtgtcagcgaattttaaacgctttaatgagccatcgtcagacagcaccaactgtatccgttcttgccaatctaacgccaatttagtgaccaatttgcccgcttcgatatgtacggcgatctcatcactgaataaatcctgttttttacagcgaataacaccgccatcttccaagattgctttgagttcagcttcgtccatcagggcaaagcctgcaggcaatgttttggatcgaacccactcagtcaaagtcagttcaatcggattttctaacgttagcgggacgacaggtaacgaccccaggcttttacgcagcaaagccaatgtatcttcagcccgtttagcacttgcggcatcgaccataatcaggtcattgacagtatcaatccacaaaaaagtttgattaaaacggctgaatgcacgcggcaacaaactgtgcagtacttcatctttcaatgaatctttttcagttttcttcagtttgcggtgctgttcaccttccaaccgttcgattttgtcctgcaactcttgcttaatcaccggtgacggtaagattttctcttctttgcgcgcacaaataacgatctgaccattaacggtgtgagttaatgcatcgctgtgcgaacccatcggtgatacccaaccggttttcgccatatcctgactaccacaaggcgtgaaactaaaggcgcttagctgtttctccatttcatccgcagacagcgaaacttcccggctcaaacggtaaaccattaaattcttaaaccacagcatagtgttatccttggctcgggcgcgcctggagcgcgcgagttaatcaacgcagggcggcatgataacgaattggcgcgcgtgtccctagtaaaaaaaataagaaaaaagcagagccagtctattatttgttgaatgttatcttcggtttaattgattaaaaacagacggaatgcaaaattatggataacaaagattgtatcgctacggtgtattgttcaaactgaaaagataatattttcattatcatagttatccagatcacagttatcctgcctagcagggtattttgatcgcgagaaaataaaacaatcttgtcaacgaggtgagatgcgatgcgcattggtatagatctgggtggtaccaaaatagaggtcatagcattggccaatgatgggcaggtgcttttccgtaaacgggttggtactccacgccatgattatcaaaaaaccatacaggctattgctgacttaatcgctgatgccgagcacgcgactggcgagcaaggcagtatcggggttggtatccctggcacactttctccttttaccggcaaagtgaaaaactcaaactcagtatggttgaatgggcgggagttagataaagatctctcggtgtttttgaaccgcccggtgcggttagccaatgatgcgaactgtctggccgtttctgaggcaacagacggggcgggggcaggtaaaaaatgggtgtttgctgccgttatcgggacggggtgtggctcgggtattgccattgatgggggttcgcatgctggcggtaatggtattgccggtgaatgggggcataacccgttaccttggcaagatgaagaagagcgagaatatgcacaagaagtgacgtgctattgtgggaaaaaaggctgtattgagacttttgtatcgggtacgggttttgccactgattacttcaggttgagtggaaaaccgctaaaaggccatgaaattattgagttggttgagcagggtgatgttatcgcagaacaggcaatgaacaattatgagcggcgttttgccaaatcgctggcccatgtcattaacctgttcgaccccgatgttgtggtgctggggggagggatgagtaatgttgaccgcttgtatgacacattacctgcgttaatcagcccctgggtatttggcggtgagtgtgcaacgcctattcttaaagccttgcatggtgattcgagtggggtcaggggggctgcctggttatggaatacccttcgtccttgacgctacagcggtgttagctacgttcactcacccgaatcacttactcatgtaagttcatcgggatttgctcacttgctgccttgctgtaacgccaatgactttgggtatttcccttagaacttgacgctacagcggtgttagctacattcactcacccgaatcacttactggtcgttgaccttacaataaatagactcatcgggatttgctcacttgctgccttgctgtaacgccaatgactttgggtatttcccttagaacttgacgctacagcggtgttagctacattcactcacccgaatcacttactggtcgttgaccttacaataaatagactcatcaggattaatgagcctcatccttgaggcttaccctgtgggctagcatcaatgttgttcaaattgattcccgaccgatctgttattcacttgctgccttactgtaacgccgatgagttggggtatctgttcagtcttgattgactcggaaggcattatccaaacggctgacgcctaacccgttaacttttttcacttttatctgcaccgggatccgatctttcattgcctctacatggcttatcaccccaatagttttgccggaagcattcaggctatccaaggcatccagtgcggtatccaatgtttcagcatccaacgtaccgaagccttcatcaagaaacagtgagtcaatactggttttatggctgactaaatcagacagtgctaatgctagcgccagactcaccagaaaactctctcctcctgacagggtgcgagtatcgcgtatggcatccgcttgccaggtatctaccacctgtaattccaatgcatctgtagtcttacgttgtaatagatagcgcccatgtaaacgactaagttggttattggccagataaaccagatgatcgagtgtgagaccttgcgcaaatttacggaatttatcgccttctttggagccaattaattgattgaggtaactccagtcatcatattgctgctgactacgctcaatttgttcaaatagcgtacgttgattatgacgtcgagtggtgtcgctttctaactgattgcgtagttcgccttgccgtaacgttgtggttttcagttgtgccaatagctgttctgactgttgttgtaataaggttaattcagaggacttatcgacaccttggggacaaagctgtaaatgttgatccaatatctccctggcttgttgcaggcggatctgagcttgttgccgtcgctcatttaattgctgttgcagttgttgtagatgctgcctttcttcctcacttaacagggctgcggttaatgccgtttcatcagcaaattcgctggtggacagtgcttgttgcaattcagcctgtgtggtggtagcacgttgctgatactgttggcattgttgctccagcccggtcagttcacctgatagcctattcagttgggattgaacctgttgtagggctttttctgcgttttgctgggcaagctctgcctgttgctgctgtaagcgtaatcgctggcggacttcggcaacgatatcttcaccaaacagtgcccggcgctgctggatttgctgctgtaatagcgtttcagcttgctggcgttgttgacttagcgccgataattggtcaatacactcctgtaaatgacgccgttcattctcaatacgtgtttccagcgttttttgttcaatagtgagccgctgttgctcttgctgatgttgttgccagcgctgacattcctcttcccgctgtgctagccaattctgttgttgatcggcatcgggtactgataaggacaattcagtcagcgtatggtttaacacttgctgctgagctataagtgcttcttgctggtgctgatattgcgattgcagctgttggtaggtttgttgagcatttttttggcgttcagtgatcagtgccaactgttgttgatgttcttgctgccgttgttccaactgggtcaggatatctttggcctgctgatactgctgagtcagacgctcatactccaccagctttagttgacacgcctgttcttgctgctcatgttgctctagccacagggctaatgcgtcaggttcattcaaggtgaaggccagtgataacggttgtgccagtgtttgccaacgttgctgatatgcagctaactgttggcgatggtcttgtaactcttgctctatacgctgctgatgttgttgcatgcttgcaacttgggtacgcaactcagtgccttcagtgtaaagctgttcgacctgtaggcgcagttttgcaactcgcacggctgtttctgagggtttcactgcttggtacgcagtaatcgccgggtgctccacagcaccacatagcgggcaggcatctcctggttgcagtttggctctttctgcttccagtgtgacaagctgtttttcgcgttccagtaaggcttctaaatcaaccagatgttgtttctgctgctgatataactggcgtttttcggttaactgttgctctaactgtttaagctgttgctgctgagccgtaaattgttgctgctgcttatcatagagtgcttgtatttgttgtgctaaaggcgataaagccgccagttgttggcatatctgacgttgctcattgaactcgtttagttgctggcgcaactgtgctgaaggttgctgttgttcaaggactaataatttctgctgaagatagcttgcctgtgcgcgagcctccgctaaggccacttgttgttgtttctcttgcgcacttagtgttgtagcctgctgttgcagcgtggcgagtaaggttgtttgttggtgtagttgttgctcactttgagctgattgttgttgctgtagttgtaattggcggaactgctcatgccataagggaagatgtttttcccagtgctgatgatgggcatgtaaattggcatagtctgctagctgttgcaggcgttgatgggtctgcaatagtttttgctcattcagcgcaagttgttggctgttttgctgctctttagcgcgtaattgctgaatttgccctgcaagttgcgacaatgtctgctgctgctgggtgataaggttatccagcggcacgatccgttgttcgatgagtgtttcttgctcatgttgattaagctgttgctgttggcgtgccgcagtggcttgctctactgcctgagtcagtggtgtgagctgtgccagatattgctgctgttgttgtgccaatgcggtgatgcgttgctgtgtttgttgtaaatctttttggctacggtcacgttctcgttgcaacgggcgcaatttttctgccggttcgctacgcgctaaacgttgtaggccgggtagtgcctgttgatactcttgctcaacgagcacctgttgctgctgatattgctgtacgtgttgttgctgctgctgccaacctgttagccagtttatttggttttgcgtgacgagttgttctttactgagctgctgctcttgttgactcagtgcatcaatttgctgtgccagggccaggcgttgttcttcatttaacagttcaatgccgctggcacgttggtgcaatgcatccagatcgatcttggcttgtttatgtttttcaaatacgcgttcagatagacgtccgtagatgtcggttcccgtcaattcttccagtaactcagcgcgatcattggcatctgcattgaggaaggcggcaaattgcccctgtgacagcatcatggacttggtaaaacggccaaagtccagaccggtgattgccgcgatcatatctaatttatcgcggaccttatcggccaagattttgccgttttcgcataaggccagttctactttgggggcttgcagattgccatctgggctgtttctggcacggcgctggctccaaaaggcgcgataacggatacctttcacgtcaaattcaacttctgccagtgattctgcagtatggcgcgtcatcagttcattctggctgggggttacgatgaggcgaggggtttggtggtacaacgccagacagatagcatctaacagcgtggtttttcccgcgccagttgggccggtgatagcaaataagccgttactggcaaaaggttcggcagtgaaatctatcttccattcgccctgtaatgagttaatgtttttcagacgtaggctcaaaattttcattgggctggctcctccgccacaccgttactgccatcttgtgctatttcatcaaccacgtaattgaacatttggcgcattcgctgctggcgaggctcggataaatctgcctccagtgccagcctacgttcaaatacgtcactgacggtcaattcgtttagcgtttctttttcctgccggtggatgctgttattacgttgttctttgctacggcgtagtaataccacttcaacgggcaagttcgctgccagtgcctggatccgtctttgaatatcggtgagatagtcttgggttgccacttctatatccaaccacacgggtaagccttcatggccagcaaatgccgctaattgctgctctatttggcgcaaatcacctttgatcaattgcatcggttgaaattgtggaatgaagagtggggtaactgatgacagattttgctggtcaaactccaccaaatacacacttttctctttgcttagttcatcaaaactgagcgctataggtgagccgctgtagcggatatgttcagttttagcgacctgttgagcgcgatggatatgaccaagggcaatgtaatccgcgggtggaaaagcctgagccggaaaggcatctagtgtaccaatataaatgtctcgtactgagtctgtggttgtcacacccacggtggtcaggtgcccggtggcgataatgggcagaggcaagccaagctgagatcgcagttctagggcgcgttgatataacgtttgatagtggccagcaatagcttcttgtaatgccagttgtttctggtcaccagactcacccgcttgactggtcaccagatcacggggccgtaaaaacggaatggcgcatagcaccgctgcgggttgctgctgtctatttttcaggataatcacttgttgtttcagatcacgactggcacatgagattaccgaggtattcaggtatgaaagtaaatctcgtgattcattcagtgtggctaccgaatcatggttgccacccagtaccactaattgacaggcggtaggctggagctcaacaataaaacggttatagagctcacgggcatagctgggcggggcaccggtatcaaaaatatcccctgcgacaatcagcgcatcaacctggtgttctttgatctgctcaatcaaccagtgcagaaatgcctgatgttcagcagcacggcttttggtgaaaaaatactgccccaaatgccagtcagaggtatgaataatacgcataaagctctcgctatggccgatgatgacgaaagagaatggcgctgattataagcgttggcatcaagatgtcgcggtgaaaaacacaggatgaaataaatctccgagacgcctcgcaaagttgattactgcgtttggcaaaaaaaataacatttatcactatgcttattgctcacggaagcgtgatatttttcataaatctgtcacaaaactgacgcataatggccccgaaatcgaatagtgaccgctaacatactggcagggttgatgatggcaagacgcatactggtggtggaagatgaagcaccaatccgtgagatggtgtgctttgtgttggagcaaaatggctaccaaccgttagaagccgaagattatgacagcgcggtagctcgcctgtcggagccttttcctgatttagtgctgttagactggatgttacccggcggctcgggtattcagtttattaaacatatgaaacgtgaagctttgacccgggatattccggtgatgatgctgaccgcccgtggcgaagaagaagatcgtgtgcgcggtttggaagtgggcgcagatgattatattaccaagcctttttcacctaaagagctggtagcgcggatcaaagcggtgatgcggcggatatcgccaatggccgttgaagaagtgattgaaatgcaagggttgagccttgacccttcatctcacagggtaatggcgaatgatcaggcgctagatatggggccgaccgagtttaaattattacacttctttatgactcatcccgagcgtgtttatagccgtgaacagttgcttaattatgtttggggcactaacgtttatgtagaagatcgtacggttgatgtgcatattcgtcggttacgcaaggcgcttgaaactgatggtcacgataaaatggtacaaactgtccggggaactggataccgtttctcaacgcgctactgagttttcagtgccggagaattcgttgtgttagaacgcttatcatggaaaacgctggctttagagctggctcttttttgtttgcctgcattattactgggggcgtttattggttatctcccttggttattgctggtttcagtggtcgctgcgctgacgtggaacttttataatcaactcaaactctctcattggttgtggcttgatcgcagtatgacaccgccgtcggggcgttggagttgggaacccctattttacggcttatatcagatgcaattgcgcaaccgcaggcgtcggcgcgaactggcgcttttaattaagcgttttcgcagtggtgcagagtcactgcctgatgccgtagttatcaccacggttgatggtaatattttctggtgtaatggtttagctcaacaattgttggggtttcgctggccagaggataatgggcagcatattctcaatttattgcgctacccggaatttagccaatatctgcaacaacaaacgttttcccgcccactgaccttgcaattgaataacggttactacgtggagtttcgcgtgatgccttattctgaagggcagttattgatggtggcccgtgatgtgactcaaatgcgccagttggaaggcgcaagacgtaacttttttgccaacgtcagccatgaattacgtacgccgctgacggtgctgcaaggctatctggaaatgatgcatgaccaagagttggccgggccgttacgcgataaagctttggggacgatgcaagagcagactaagcgtatggatgggctggtgaagcaacttttgacattatcacgtatcgaagccgcaccaaatgtggatttaaatgagcgggtggatattccgctgatgttgaaaatattgcagcatgaggtacaggcactgagcaatggccgccatgagattactttcagggttaacgatcaattaaaggtattcggtaacgaagaccaactgcgtagcgcggtatcgaatctggtctacaacgctgtaaatcatacgcctgaagggacgaaaattgaggtctgctggcaacaaacaccacaaggtgctcaatttcaagtcagcgacaacgggccggggatccctcctgagcatgttcctcgccttacggagcgcttctatcgggtcgataaagcccggtcacggcaaacggggggcagtgggttggggttggcaatcgtgaaacatgctctgagtcaccatgatgcgcgtttggaggtgatgagtgaaattggtctgggtacccgttttatttttaccttaccgaacaggttgattgttccaactgttttagtcgagaatgcagtcaaatcttaagacggtgcggataaaagcctaatgaaatggggaaaactggcgctcttaaatgtcattttatggcatagctatactgtttttgcgcaatcaatagctttagtacagccagtggctttaacccgatcagtggctttaactcgatcagtggctttagtactgccagtgacgctagcctctccctcaattaccgtctctccgtcggtaccaatgccagttgccaacaccctatcaggaaacctttccagtgttggttctgacacgttggccaatctgatgtcattgtgggcaaatgatttcaatcatcactatcctggcgttaatctgcaaatacaggctgcggggtcatctaccgctcctgctgcgctggctgccggggcaacgcagcttggcccaatgagccggccaatgaaagctggcgagattgctgcttttattcaacgctatggctacccaccgttagccgtgccagtagccgtggatgcgctagtggtgtttgttcatcaggataaccctctgaataggctgacgttatcgcaactggatgctattttttcgcaaaatcgccgttgtggagaaccccagaaaattcaacgcttcggtgacttggggttgagtggcgattgggcggcacgccccctgcaacgctatggtcgtaattctgcatcggggacgtatggctattttaagcgccgggtactctgtgatggtgattttataaataatatcaacgaattacccggatctgcatccgtggtgcaagcggtggcgggttcattgaatggcatcggttattccagtattggttttcgtaacagtggtgttaaatcactgccgttggcagcgagtgggcaagattttgttatgccaactgcagaaaatgtcagtaatggcctctatccgttatcacgctatctctatatttatattaataaagcaccagggcagccgctggaagcactcactgcggcatttcttgagcgtgcgctatcccccgaagggcaaaagttggtcagccatgatggctatttgccattaccgcctgctatgttgaataaaacccgaaaaacattgggttttactgactaatctgctctgtatatgtactcaaaagtagggtatatcgctgtttcaaccaacaaaaataattttgggttattccggttgagtgaaattgatggagcctgtgctgcctatcggggcctatttatctgatattctcgctatgagcggttaactgttggctataaataatacaaatcatatggtgcatatcgttgtaaactcgacatcattgactggcttgtaaaaattatctggacgatgattctgcttttatgatcccagcttgcctttctccgctataaactgtctacttagcgccgttgttggcctattccacctgcaaataacttcaaaaatactgcatactgtcgaaatagatggcttttaaaccgtcggagttcgtgtttatcagagctttgtatcgtttcgatctcgtaggaaagaccacagcgtagaattttttcttttggtcattttaactaggcaactatttcactatgagtcatcgtttatcatctaaagatattatggcattaggttttatgacctttgccttattcgttggggcgggcaacatcatcttcccaccgatggttggattacagtcaggagaacatgtgtggtgggccgctctgggcttcctgattactgccgttgggttaccggttattaccgttattgctctggcccgggtcgggggcggtattgatgctctgagtacgccaattggtcgtagtgctggtttggtgctggctactgtctgttatttggcggtaggcccattatttgccattccgcgcactgctaccgtttccttcgaggtcggcattgcgcctttaacgggtaatggcccgttaccgctgtttatctatagcgttgtttattttgcattggttattggaatttcactgtacccagggcgcttgttggatacggtcgggcatattctggctccattgaaaattttagcgttagctattttggggattgcggccctgatctggcctgcggggccgttgattacagcaacagatgcttatcagcaagctcccttttcctccggtttcgttaatggctatctcaccatggataccttgggtgcattagtcttcggtattgttatcgtgaatgcagcccgctcgcgtggtgtggtttctgccgtgttactgacgcgttataccatttgggcggggttgattgccggtattggcctgactctggtttacctaagcctgtttaaattaggctctagcagcggtagtttggtacctgatgcgcaaaatggcgcggtcatcttgcatgcttatgtccagcacacctttggtggcttgggcagtatgttcctggcggcactgatctttattgcctgtatggtgacggcagttggcctgacctgcgcttgtgctgaattctttgcgcaatacctgcggctgtcataccggacactggtgtttatcctcggtatcttctcgatgctggtctctaatctggggctgagccaccttatccagatttctattccggtcctgacggcgatttatccgccttgtatcgtgctggttttgatgagctttaccttacgctggtggcagcatgcatcacgtatcgtcgcgccagttatgttgattagcctggtgttcggtattcttgatgccgtgaaagcctctacttttgcgaattttttaccggcatgggctcatcatctgccactggcagaacaaggtctggcatggttaccgccttccttgctggtattcgtcgtcatagggttgtacgatcgcattttctgtcgccagaaaattgtggttaaacaatagctgcgcggcaatagagtatttttagccacggttaatatccgtggctttttgctgaaaaaagacggggctttgtgaatggaattaccagttaaaaataagcttaaacgtggcctgacgacacgtcatattcgttttattgcattgggttcagcgatagggactggcctattctatggttcggctgatgcgataagaatggccgggccaagcgtgttgttggcatacctgattggtggtgtggtggcctttgtcatcatgcgtgctttgggtgagatgtcggtcaataacccacaagccagctctttctctcgttatgcgcaagattatcttgggccgatggcaggttatatcaccggctggacgtattgttttgagatcttgattgtggctattgctgatgtgacagctttcggtatctatatggggctctggttcccagatgtcgctcattgggtatgggtgctgagtgttgtcttgatcatcggcgcggtcaatatgatgagtgtgaaagtcttcggtgagcttgagttctggttctcgtttttcaaagttgccaccattatcatcatgattttggccggtatcggtatcattgtttggggtattggtaacggtggccagccaacgggtatccataatttatggactaacggtggcttcttcagtaatggctttgttggcatgatcctgtcattacaattggtgatgtttgcctatggcggtattgagattattggtattactgccggtgaagccgaggatccgaaaaaatcgattccgaaagcaatcaactcagtaccatggcgtattttagtcttttacgtcgggaccctgtttgtgattatgtccatttacccatggaatcaagtgggcacgaacggtagtccgttcgttctgaccttccagcatatggggatcaccattgctgccggtattttgaactttgtggttatcaccgcttctgtatctgcaattaacagcgatgtgtttggtgtcgggcgtatgctgaatgggatggcagaacaaggccatgcaccaaaagcttttactgctatttctaaacgcggtgtgccgtgggtcacggtgctggtgatgatgtgtgccatgctaattgcggtttatctgaactacatcatgccggaaaatgttttcttggttattgcgtcattagcgacgtttgctactgtctgggtctggatcatgatcctgttctctcagattgctttccgccgttcactgagtaaagatcaggttaaagcactggatttcccactgcgtggtggaacctttacttcagtgctagccatcattttcctggtatttattatcggtcttattggttggttccctacgactcgaatctcactgtatgtcggattagtgtggatcgtgctgttgctggtggggtattactttaaggtcaagtatcagaaaaaacaggctacgctgatcaagaatgctgattaaaaacacagttcaataaacactgagtcgataatcgatacaaagccggggtacagttcatctgtcccggcttttttcttttaattccggcaagttgagaataataccagcaagttgaaacaatcttctccgccccctctctcatcctcaatatttatactcacagatgagggggttctgtccacaacgtggcatggtgagtgacgataaactatttatagactcgtcattcttcaagctgcatgtgtgctggctatgttcgttactcggcccgttcatgggacttgcctcgacgaagcatctgcttccggcggatttggctctcgcttgtcgccttcctgcaactcgaattatttagagtgtatctatcaaatagttatatccaataaatagttacatctaataaatggtttgtatcaaaaatcgtatatctcagatgaatgtgtcgcggcgttagtgtctgcatcaggttaatgtctgtagcaggttagtgtctgcatcaggttaacgtctgtagcaggttagtgtttgcacaaagttaatgtctgcaccagatagtcttcacaggaatggttttggttaaagcaggagaattttatgcttagtggttggcaccttccggtctcgccttttgttcgtttggcagacgacgcattacatatcacgctctggttgcaaggtgatagtttacctgcgcaagtctttctgcgttgtgagccagataatgaagagtggctgctcactatggaggggcatgagagccatgatcgttggcgctatagcgtttctttaccgttatatgaggggcagccaacccggcgctactgcttcaaactattatgggatgaccaccaacagtggtttggcccgttggggttctcggtgattcctccagcacagttggcacagtttgctgtagatgtacccgatagcgggcctgattgggtcgcggaccaagttttttatcagatcttccccgatcgctttgccagtagtcaggcagatcatggtgtgcaggaggggagttatattcatcatgcggccggttgcccggtatctcgccgcgagtggcagcagccattggatgatgtgcatgccgcatcgacattttatggtggcgatctggccggtattagtcagaaaatcccttactttcaacaactgggggttacggcgctgtatttgaaccccatttttaccgctcccagtgtgcataaatatgatactgaagattattatcaggttgatccctacttggggggagagcgtgatttcttgcaattgcgagccgccacccgtgaagtaggaataaagttggtgctcgatggcgtgtttaaccacacgggtgattctcatcgctggtttgatcgctatcaacaaggggaaaatggcgcctgccatcacgaagattcgccttatcgtggttggtttacgttcctccctgatggacgagcattagattggaaaggtaatgccagtttgccaaaacttaattttgccaatgaagaggtcgctgaacgaatctatcgcagtgatgacagcgtcgtgcgttattggttacggccaccatacagtattgatggctggcgtctggatgtcgtacacatgctcggggaagatggcggcgctaaagggaatttgcaccatctgcacggtatctatcaggcagcaaaagaagaaaatccgcaggcttatattctgggcgaacattttggcgatgcacgtaattggttgcacgctggagtggaagacgcggcaatgaattatatgggttttgctttgccggtccgcagttttctcgccgagctagatgtggcttgccatcctataaaattggatgctgcggattgcgcctactggatggatgagtaccgcgcaggattgccccatagccagcaactccgtttatttaatcaattagatagccatgatactgcccgttttcttaccttattaaagggtgataaaacccgtatgcaaatggcgctaatatggttgtttagttggattggtgtgccttgcctattttatggtgatgagattgggctggatggcgggaatgatccgttctgccgcaaaccgttcccgtgggatgaggctcagtgggatcatgacctattatcactgtgtcaacgtatggcggctttacgccacaaaagcatagcgttgcggcgcggggggtgtcaggtgatccatgccagtggtgattccctggtctttattcgtagctatcaaactgagcgtgtgatggtggcgatacaacgttccgatgatgcggatattttcctgcccgcctctcctttactcaatgtggctgagtggcagcgtctggaaggtggaggagacctggctgtcagtgagactggcgtaaacatggggctggagggtaagagtgttaccttgtggtgtggtgttggtgagtgctaacttgcaaaaggcgcggtgacggataactcactagagcagctcagggataacaattcagtgataactgagctgtttttttgctccagtaagataatatttatagggataagagaatatttatagcgcgaataactctcactgaaaggagctttatatgggcacagcgaaaagaacagcattggttatcggtgcttcacgggggttagggctagggttggttgatgagcttagtcgccgcggatggtctgtcaccgcgaccacacgtggcgcggctcaagatacgtcagcacatgccgcccattggttaaaattagatattaatcagccagaaagcattaagcagtttttaccacaagtacaggggcagcgattcgacctgatatttgttaacgccggaatctctgggccagcacaccaatctgcgatcgatgccacacccgatgaaatccaggaactgttccagactaacgccatctcgcctatccgaattgctcaacatttgctggcacaacgcaatccaacccagagcgtattggcgtttatgtcttcccagttaggcagtattgaacgcaatgtttctgggcataaaccgttgtattcagccagtaaagccgcattgaatatgatgacgcgtaatctggtggctgaagttgcagatccgaccttgacggtattatcgattcatcccggttgggtgaaaacggatatgggcggtgatgcggcaccgttgacgattactaccagtgtgaagggcgtggtcgatcaaatcgaacaggcttcagggaaagggggccacggatttattgactatcaggggcattcattaccgtggtaatgctctttgttcaccattaatacgctccactctaatgaatatcccccatcaatagttcgataggggataatattttcagatacttcgccgccgatggcttggttagtcatcggtcaatagctaaatcaataaccaatagcttaattaacgacccatggcttaatcttaattaataaccattagattgattagtagtcattagattgattagtagccaatagcagcccctgcggggcgacggacatcattggcaccgtacaggtagccctcacggactttgccggagacagcagaatcattacccgagttagccgggctgacgccctcaacaccggccaggccgactaaaatcaactccgctgcgccccaagggctctgttcaaccatcttatatcccatactcttcaggatattgagactgtccgctgagacaccgcgttgctcataatagacttcatcgggtagccactgatggtgaatacgtggtgcatcaaccgcttcttgcggggccataccgtggtcaatgacgttcagggcggtttgcagcgtgatgctgataatccgtgagccacccggtgaacccaagaccataaatgtttttccatctttggtcactagtgtcgggctcattgacgatagtgggcgcttaccgggggcgatagcgttggttgcaccttgtaccaatccatacagattttgttcacccactttaactgtaaaatcatccatttcattattgaggaagaagccagtaccaggagcaatgaccaccgcgccaaagcgcccattaacggtatacgtggtagaaacggcattaccctcatgatcgacgatggagtagtgtgtcgtctccggtttttcgtgaggttgcatacccggttgtacttctactgatggtgttgctttgttggcgacgatctgtttacggatatcggcggcatagcttttgctcagtaggcggtcaagcggatttttaacaaactctggatcaccgaggaaggtattgcggtccatataggcatggcgcattgcctccgttagcgtatggatatagtcagcggagttaaagcccatacttttgaggttatagccctccaaaacatttagcgtttcacataatgtgacgccaccggaactcggcggtggggctgaaacgaatttataaccgcgataactacaggtaatcggtgcggtttcggtgattttataatcggcgaaatcggcggcagtcagtattccgcctccctttttagccgctgcttccacagcttgcggtattttaccttgatagaacgcatccggccctttttctgaaatcgcgcttaacgtatccgcgagatcggcctgaaccagacgatcgcccggttgtagtgcctctccatctttacgcaggaagatacgtgcagactcaggatcctgacggaaacgtttgacggtggtgtccagaatatcggtatcggcgcgagtcaggataaagccgtcacgggccaaacggatagccggtgccatgacttgctgacgggttaatttgccgtattttttttgcgcactatccatgcccaataccgtgccaggtacacctaccgccagatagccatacaaactggcatccttggtaacgttaccgtctttatccaagtacatatcagcattagccgtggaaggggcggtttcacgaaagttaataaatgtatcggttccatcggcaagatgaatggtcataaaaccccccccgccaatattgccacagcaaggattgactactgcctgggcatatcctactgctaccgcggcatcaacagcattaccgcccatttttaaaatatcagccccaacctgtgaagccagatattgggaggtcacaaccatgccatttttcgcttctaccgcgggtgtggaggcggcatgcagcgtgccacttaccagtaaagctaatactgctaatggcttattccattttgttaaaaacatacgaactcctattgtgctcctgcctgccgggagttacccggtcatcgttgtctggcagcactaaaaacgctgctttgtatgtggaatataaaaaatttgtagaaggtaaaaatttgtggaatgtaaaaattacacaccaattataattaatagcagaattattattttgtgagactcattaattttttgttaaatagcaggatgagagggtttttaattcaacgtattgatttttatcaatataaaatcgaagcaaaggaaagtgactgattggaaataaggtatgatgaatcgaagtgaggggcggtatctaggggaaaaaaaagccagtcagagtgaactgactggcttgatagcccccgagcttgtcggggacggtttaaatcttattacagcttagatgcgttctcagacaggtatttagctacgccgtctggggatgcgcccatacctgctttgcctttttcccactgtgcagggcaaacttcgccgtgttcttcgtggaattgcaatgcatcaacggtacggatcatttcgtcgatgttacggccgattggcaggtcgttaacgatttggctgcgaacaataccatttttgtcgatcaggaatgaaccacgcagtgcaacgccagcatctgggtgctcaataccgtaagctttctggatttcacgtttgatatccgcaaccattgggtatttaacttcgccaataccgcctttatccactggggttttacgccatgcgttatgcacaaactctgaatcgaaagaaacaccaacaacttcaacaccacgtttttggaattcttcataacgatggtcgaaagcgatcaattctgaagggcaaacgaaagtaaagtccattggccagaagaataggacggctggtctgccgttcaggtgctttttcaggttaaagttttcaacgatttcgccgttaccaagaacagcagccgctgtaaaatcaggggcttgacgagttaccagaaccataaattactcctgttaatagagatggattaaccagatgtcttaaaaactatcgtaacagcataggtatttaagtgtgatgaagaaaggaataaataccaattgttatgatagtttttgcctatcgttaaacgattttagttttgcagtcttgctaagatacctatttcgctgaaaagcgcaagtgggctgcactcagtagctataccgtaaattcagtagctataccgtaaattcaatggctataccgtaaattcaatggctataccgtaaattcaatggctataccgtgaattcaatagctataccgtaaatgggtagacagcaaagaacattttaatctaaatctgcttatgttgtgcctgtcgcatcattgtagggtaaaacgtcaaaaaaaggtcttctagcggttgataatgttgctctatagcgtaaaaagaccctgcaagggcggctagtttgggccgccgattcgccataccttgtagtacatcagcaatgaaggggagttcagcatagcgttcgagccaacgctctgaccacagataagcattaaggctttggaaacgagcgggcgtatgtggcaaatgtggcaaaatttggctctgtgcatgctgaagaaaatcgggtagcgtgcaatttggtaccagttgatcccagtggcgcgctagaaaatggtcccacagcacatccagtgtgatcggtgaaacccggcgataatcagcactgaaataggtgcgagcctctttaaccaacggtagcgtatccgtcataacatcaactcggcgatgcatcataataccagcgacaatctctggggggtattcaccctgtggattaccacggacaaaatctgccaagagattacccagcagcgagctgtcggccagagcagcgagatggaggtgtgcgagaaagttcatgctgggaagtataatgcaaatcaccacgaactatccttatttcttgcagccagcccttgagggctctagactagccgcctgtttttgtgaaccgaccccatgaggctgtttcttaccattttgtgtactattggtgcccaaaatagtttgcagcaacacggccctgttggtgtgggtttggtcttagatgaagtggaaagccatgcgtgttgccgatttttcttttgagctaccggaagctctgattgcccattaccctcagcctcagcgcagtggttgccgcttgttatcgctggatggccctacggggacgttaacgcacggcattttcaccgatttgctggataagctggcgccgggtgatctgctggtgttcaataatactcgggtgataccggcccgtttatttggtcgtaaagccagtggtggcaagctcgaagtgctggtcgagcgtgttttggatgaccatcgggtattggctcatgtcaaagcctctaaagcaccgaaaccgggcgcagaactgctattgggcgatgatgaaagtatccgggcaaccatgttggcgcggcatgacacattgtttgagttgtgttttgacgatgagcgggatgttttcaccatcctaaatgcagtcggtcatatgccattgcctccttatattgatcgtcctgatgaagatgctgaccgcgaactgtatcaaacggtttatagccaacgtccgggcgcggttgcagcaccaactgcgggcctacacttcgatgagccaatgctggcggcactgcaggaaaaaggcattgagatggcttttgtgacactgcatgttggcgcggggactttccagccagtgcgtgtcgataccatcgaagaccacatcatgcactctgaatatgcagaagtcccgcaagaggtggttgatgcggttctggcctgtaaagcccgtggcaagcgtgtagtcgctgttggtacgacatcggtacgttcgttggaaagtgcagcgaaggccgctgaaaacgggttaattgcgcctttcttcggtgatacccgcatcttcatttatcccggttatcactatcaggttgtggatgcgttagtgactaacttccacctacctgaatcaacattgataatgttggtctctgcttttgcaggttacaaaaacaccatgaatgcttatcagcaggcagtggcagaacaatatcgttttttcagttacggcgatgccatgttcatcagccgtaatccacgggcaccgcaagagaaggttagcccgtaaatttcggtcatacaggttgtgttttttcaacgacataagcgtgtgatcaggcaaaaacaacatcagactgtttctctgatgctggaggttatgtgaagtacgaattacaaaaaactgatgggcgcgcccgccgtggtcggctggtgtttgagcgtggcgtggtcgaaaccccggcctttatgcccgttgggacgtatggcaccgtgaaagggatgacaccggaagaagtaaaagagaccggtgcgcagatcctgttaggtaacaccttccatctatggttgcgtccaggccaggaaatcatgaagctgcacggcgacttacatgatttcatgcaatggcacggcccgatcctgaccgattccggcgggttccaggtctttagccttggcgcgatgcgtaaaattaaagaagaaggggttcattttaaaaacccaatcaatggcgattcggtgttccttagccctgaaaagtcgatggaaattcagtacgatctcggttctgatatcgtcatgatatttgatgagtgtacgccttatcctgccgattgggattacgctaaacgttcgatggaaatgtcactgcgctgggctgctcgtagccgccagcgctttgatgagctgaataacaagaatgcattattcggtatcatccaaggcggggtttacgaagatttacgtgatgtgtcagtaaaagggctggtagatatcggctttgatggttacgctgttggcggcttggcggtcggtgaaccaaaagaagatatgcaccgtatccttgaacatgtctgcccacagatcccagaagataaacctcgttacctgatgggcgtagggaaacccgaggatctggttgagggggtgcgccgtggtattgacatgtttgattgtgtcatgccaacgcgtaatgcccgaaatggtcatttgtttgtgactgatggtgtggtaaaaatccgtaatgcgaagcataaggatgatacggcaacactggatgagcactgtgattgctacacgtgtcgccattatagccgtgcctacttgcatcatctcgatcgttgcaatgaaatactgggcgcacgattgaacactattcataacctgcgttattaccagcgcttaatggcgggtttacgtcaggctattgaagagggtaaattagaacactttgttgaagatttctatggtcggatcgggaagccagttccaccattaaacgtttgattctaaaattattgtctttgtatttatagagagagcagttacgatttgtcgcggctgttttatcgcactgatttcacactactgatattgataacaatcgaggaaattttaatgagttttttcatttctgatgctgtcgcatctgcaggggctccggctcaaggaaacagcatgacctccatgctgatcatgctggtagtattcggtctgattttctactttatgatcctgcgtccacaacaaaaacgtgccaaagaacataaaaaactgatggattctattggcaaaggtgatgaagtattaacatcgggtggttttattggtcgtgttactaaagttgcggaaacaggctatgttgttatcgcgctgaatgacactaccgaagtgatgatcaagcgtgacttcgtggctgccgtgttaccgaaaggtacaatgaaggctctgtaattttcgattttcccgaagggaactaccgtgttaaaccgttatcctttgtggaagtatctgatgctgatcgttgtgatcttcgtcggtctgctatatgcgcttcccaacctttatggtgaggatccggctgttcaaatcactggtgcgcgaggaatcgccgccagtgagacaacgctggtccaagtccgtgacgttttagaaaaagacaacatagcgagcaagtctattgcgctggaaaacggtgcaatcctggctcgctttagagatcctgatgtccagctacgtgctcgcgaagcactggtggaggcgttgggtgataaatatgttatcgcgctgaacctggctccggcaacaccttcctggcttgccaaattgggtgcagaacccatgaaattaggtcttgacctgcgaggtggtgttcatttcctgatggaagtggatatggataccgcgctgggcaaactgcaagagcaaacgatggataccttacgcactgatttgcgtgagaaaaatatcccgtatgccacagtacgtaagctcgataactatggtgttgaagtgcgttttcgcgatgataaagcgcgcaatgatgctatcagctacctctcttcgcgccatcgtgatttggtgttcagctccaatggcagcaacacgctaaaagcggtgatgagtgatgagcgtttgcgggaagctcgggaatatgcggttcaacaaaatattacaattctgcgtaaccgagttaaccagctaggtgttgcagagccgttagtccaacggcagggttctgaccgtattgttgttgaactaccgggtattcaagacaccgcgcgtgctaaagagattctgggtgcgactgcaacgttggaattccgtttagtcaacactaacgttgatgcttctgtcgcagcttctggccgtgtacctggcgattcggaagtgaaaaatacccgtgaaggccgcccggttgtcttgtacaaacgagtgatcttgaccggtgaccatattactgattcaacctccagtaccgacgagtataaccaggctcaggttaatatctcgctcgatagtgcagggggggcgacgatgtctaattttactaaagacaatatcggcaagccgatggcgactttattcgtagaatataaagacagcggtaaaaaagatgcgaatggccggtctattctggttaaacaagaagaagttatcaatgtggcgaccatccagtcgcgtttaggtaacagtttccgcattaccggcattgataacccagctgaagcgcggcaactttccctgttactgcgtgctggtgcgttgattgcacctatccagattgtggaagagcgtactattgggccaacgttgggttcccagaatattgcgcaaggcttagaagcctgcttatggggtctggctgtatcgatcctgtttatggtggtttactaccgtaagtttggtgtgattgccagtactgcactgatggccaacctggtgttaatcgtcggcgtgatgtccttattaccgggggcgacattaaccatgccgggtattgccgggattgtattgacgctagcggtagcagtagatgctaacgtactgattaacgagcgaataaaagaagagtatagaaacgggcggacgatccagcaagcgattcatgaagggtacaagggtgccttctcaagtatcgtcgatgcgaacataacgacgcttatcacagccattattctttatgctgtgggtactggttcgattaaaggctttgctattacaacggcaattggtgttgtaacgtcaatgttcaccgcaatagtcggtactcgtgccatcgtcaacctgctttacggcggcaagcgcattaacaagctgtctatttgaggagtacgttgtggcacaggattatactgttgaacaactaaactatggccgtaaagtctatgactttatgcgctgggattacgttgctttcggcgtttcactgttgttgttagtcgcatccattgtggtgatgtcgactaagggattcaactggggtctggatttcaccggtggtacggtgattgaaattaatctggaaaaccctgcggatcttgaccaactccgtgacacgttgcaaaacgcgggttttgaatcgccgatactgcaaaactttggtagctctcgtgatgtcatggtacgtatgccacctgcaaccggcactgccggccaggagctgggtaacaaaatcatctcggttatcaatgaatctgttgataagaatgcatcagtaaagcgtatcgaattcgttgggcctagtgtgggcagtgatttagcccaagccggtgctctggcgcttttggtcgcgttactgtctattctggtttacgtgggtttccgttttgaatggcgtctggcattgggggccgttatctcattggcccatgacgtggtcattaccatggggatcttgtcgttgttccatattgagattgacctgacgatcattgcttcattgatgtcggttattggttactctctgaacgatagtatcgtggtatcagaccgtattcgtgagaacttccgcaaaattcgtcgtggaacgccttacgaaatcatgaacgtatctctgacacaaaccttaagtcgtacgattatgacttctgcgacgactctgatggttgtgttgatgctgtttatcttcggtggtgcgatgctgcaaggcttctcattaacgatgctgatcggtgttactatcggtaccgtttcatctatctacgtggcgtccgcgctggcgctgaagttagggatgaaacgtgaacacatgttgcagccgaaggttgagaaagaaggtgctgaccaaccttcaatactgccgtgattgttaagtaatcatcgttcgatgtataagatagccctgaaactgttagtttcagggtttttttatcagtaaattccccagctaaatagctactgcttttctatacataaaatagaattaattagaatcactctattccaccatattcttcgttactgataagtttattatttttctgatagttaataaattcgtgatcagtcacctttaaaaggtaaataaaatacaggctgatattaaaaggaatatttatgactgttagttatgtcgggcgaggagagtcactttcatgggtatatggagtggacaatgtgaatataccaaattcagatgtggtcgattcaccttttaatgacttcactcaatttgataatatggatttttcggctaattataattctattttatcgagagaaaataaatcgctaattacgtcatttataagtgaatataatgataaggttaagaggttaagtgcagatgaaaattatattttaactcaaaaatatatttcatcactggatgaaatgtgtgaggaaataaataaaaaattactttattgtcatgatagtaaagtattaaaaaatgttttagattcgacgcttcaaaagcaaactgaaatgagtaaatacatagtgttactggaaggtgtgccttatcgcattgaaccaagagatatcgcagctgacattacgaatgaacgaataaatggtgctatagagttattgaattttgttgccaaggcttacccgaaaatagcgaaggaatccgctaagttgcagcgatcccgaccccatgccaattgcagtgttgagacgttgaatgactatttagaacagttaaaaaaaatattgtcaggcaagaaactactcagtaatagaagacaacgctcttcatcaattcattttaaagacgcatggggtggcggtgataagtctggacgaataaatgcgcaaaaaaacgtagagattaataagaaaatggaaggtatctatattggattcactcagcgaacgatagagagtcagactgaaaatcagtctgtggtttttaaatcatcaaaacatgagatggtagaaaataaattaatctatttagcctctttagctaatgagttgagtaagctaaatgactctattagtgatgagaatttaaaatattctataaataaagtggttggtgaagtccttgagttgaaattgaagaaaattcagaaaatggcgaaaagttcgaaatgtaatttttcattttctaatcttaagaaggatttagctatgctgagttcgcttgcggtaactggcatcgccgcaggtgtgatacctacatttatcgccaccggtatagtggctgcaatagcgcctatcttagcggcgttagggtgtgcaatatatgcatttaatccacagctaaaagaaacagaaaccagtaaattactggatgcgagcatcaaagatatcggggcgacgttggggagtgagctaaaggatgagaagttggggcgcttcgaatatctgcgccataaatatgccgcttataagtaccgtaaggctgccaagcacacattcgatggctgatcggcctttgttgtcatcgcacttcgcggtaaactgtcggtaagtttaggttcaccaatcaggaagcgttatgcattgtccgttttgtgccgctgtggatactaaagtgattgactcccgtctggtgagtgatggctcacaagtccgccgccgccgccagtgtttagattgtaatgagcgttttaccacttttgaagtggctgagctggtgttaccacgggtcataaaaagtgacgaggtacgcgaaccgttcaatgaagagaaattacgacgcggtatgttgaaagcgttagaaaagcggccagttagctcagatgatgttgaaacagcgataagccacataaaatctcaattacgcgccaccggtgagcgggaagtgccgaccaaaatggtgggtaatttagtgatggaagcgctgaaacgtttggataaagtcgcttatatccgctttgcctcggtttatcgcagtttcgaagatgtccgcgaatttggcgaagaaattgcgcgcttgcaggattaatcggcacgtggctattttttatttgaggcggtgttttgacgttttagctctaggtctatctatgtcttaacctcaaattgagtcttaacctcaaattacgttctagtctcagattaccgttagcggcagtctaaacattaaggaaagccatgcagcccgatgagttctatatggcccgagcttttgaactggcgcgtttggggcgctttacgacgtcgcctaaccccaatgtaggctgtgtcttggttcgtgatggcgagatcgtcggcgaaggttaccacttacgtgctggagagccgcatgctgaagtgcatgcgttacgtatggcgggtgagaaagcgcgaggagccacggcttatgtcactctcgagccgtgtagccattatggtcggacgccaccttgtgctgatgcgttggtcgccgcaggtgtgatacgggttgttgctgccatgcaggatcctaatccagaagttgccgggcgagggctgtataaattaaaacaggccggtatcgctgtcgatcatggcttgatgttagctgaggccgaggctgttaaccttggtttcttgaagcgtatgcggactggtttcccttatgtgcaattgaaaatggcggcatcattggacgggcgtacagccatggcatcaggtgagagccagtggattacctcaccacaggcacgccaggatgtgcaacgctttagggccgagagttcagctattctcagtaccagtgccacagtattggcagatgacccttcgctgacggtacgctggcaggatttagatgccgaaacgcaggttttgtatcctcatgatagtgttcgacagccagtaaaaattatactcgatagccataaccgcgtgactccacggcataaagtgatacagcaagacggcccatgctggctggctcgcgtagatgccgatgatcagccatggcctggcaatatcgaacaactgttgctaccacgttatggtaatggcgtggacttggttgtgttgatgatgcaattggggaaacggaatattaactctgtctgggtagaggctgggccacaactggcgggtgcattgttacaagccggagtggtggatgagttaatcctttatatcgcccccaaactcttgggcagtgatgcgcgtggattatgcgagctagctgggctgacgaatttatcgcaagcgcctgagtttgcatttagcgatgtacggctggtcggtccggacttgcgtttacgcttgaagccaaagtattaatctaattattgggtagggaattcccctgctaatcacggccttgtcaggcgttttacaaatgcgcaggggcgggcggtgaaagaatatgatagaatccgcccccctgcggggtatgaacccatattgaggaaagctatgaacgttatcgaaggtgttgttgctactcctaatgcccgtgtggcgattgcgattgcgcgttttaacaactttatcaacgacagcctgctggatggtgcaatagatgccctgaaacgcattggtcaggtgtccgatgacaacattaccgttgtctgggtgccaggcgcttatgagttgccgttagttgctaatgtattagcaaaaacaaatcgttatgatgcggtgattgcactgggtacggtgatccgtgggggcacagcgcactttgagtatgttgctggcgaagcaagttctggtctatcaagtgttgctatgaacagcgatattccagtggcgtttggtgtgctgaccacagaaagtattgagcaggcaatcgagcgtgctggtactaaagcaggtaataaaggtgcagaagctgccctgaccgcgcttgaaatgattaatgtaatcaaagctattaaaggctgaatttagttaaggggaattccgtgaaacctgctgctcgtcgccgcgctcgtgagtgcgctgttcaagcgctttactcttggcagttgtctaaaaacgacatcgctgatgttgaattacagttcctgtcggagcaggatgtcaaagatgtagacatcgcctattttcgcgaattgctgtcaggggttgcggttaatgcagcatctctggatgcattaatggcaccttttctttcccgtcagctcgaagaattaggtcaggttgaacgtgctgttttgcgtattgctctgtttgaactgagcaaacgtgatgatgtcccttataaggtggcaatcaatgaagcgatcgaactggccaaaactttcggcgcggaagatagccataagttcgttaacggagtgctggataaagtcgctccgacggtacgtaagagaaaataatctcgtgatatcccacgtcattggtgttgcagccaggcagtaatcgaggaaatctcgttgagctgaccccgtcagtgattcgggtgacaaatctgccaagagcagattgaatgctgctcatttttcatttatgcaaacagtgctgcaacgtcaagatagaaggatatacattaacgatataaattaaggccggtatccggccttaatttatatatcagttaacatttctggaattgtattatggcatgtggcgaatttgacctcattgcccgctactttgaccggtttagaagtaaccgccgggatgtggagctgggtattggagacgactgcgcacttcttacagtggcagagaaacagctgttggccatcagtaccgatacactggtgtccggtgttcatttccttccggatatcgatccggccgatcttggttacaaatctctagcggtaaacctcagcgatttagctgcgatgggtgccgatcctgcctggttatcgcttgctttgactctgccatcggtaaatgaagattggctacaggcattcagtgacagcttatttgatcaactcaattactatggtatgcaattgatcggtggtgataccacccgtgggccattgagtctgacactgactattcacggttttgtccccgaaggccgtgcattggcccgtgctggtgcgcggattggtgactggatctatgttactggcacattgggtgacagtgctgcgggtctggctattttgcaaaatgagctgcgggtagataacgaaaccgatcgagcggcattaattcatcgtcatttacgaccacaaccccgagttttacaggggcaagcattgcgtatgcttgctagtgctgccattgatatttctgatgggttaatttctgatctgcagcacattctgaaagccagccattgtggtgctcgtattgagctcgatatgttgccgtattccgatgcattaaaaaatcaggttgatactgagcaagctctccgttgggcattgagtgggggtgaagactatgaactgtgctttaccgtacccgagatcaaccggggcgcgttggaagtggcactcagtaataccggagcgggttatacctgtattggccaattaggccctcaatcggaaggcgttaaattcttccgtgaaggtaaaatagtcaaactggatttccgcggttttgatcatttctcaacaggtaaatctcatggatgaagccaagcgccgtctacggttgagtaatccctggcacttgctggcgaccggttttggcagtgggctatcaccatgggcaccgggtactatggggtcaattgccgcgatcccattctggctgttactgattcagttgccatggcagctttacgtcttgttggtgatgttcagtatctgtattggtatctatatttgccaccgtacagccaaagatatgcaagttcatgatcacggtagtattgtgtgggatgaatttgttgggatgtggataaccttgatggcattgccggtaaatagctggcaatgggttgtggcagggtttatcgcattccgtatttttgatatctggaagccttggccgatccgttggtttgaccgtaacattcatggcggaacggggataatggttgatgatattattgccggggttgttgctgctgcggttatctttgtgattgggcactattggccgctgtaattgttcaattaattcagggcatcagagagactatcacgtaaaggcataacccacgggctatgcctttattgtttctgatatctaaaaaaattctgagatctaaaaaatatgctcggtgagtttaactaggcgagccgcggttaagctagccaagcttcaatttgacgctgtatacccgccgcatctaaaccgagttcagatcgcatttcgtcttgctcaccttgtggcacaaatagatcgggtaaaccaatgttgagtactgggacccatcgccgttttgccattaatagctcattcacaccgctacccgccccccccatgatggcgttttcttcgacagttactaatacctgatgttttgctgccatttccaataccaattcttcatctagcggtttcacgaaacgcatatccaccagcgtggcattgaggttttctgcggcaagctgtgcctgagcaagtaacgtaccaaagcaaaggatggcaatcttctcaccttcacggcgtagtacccctttgccgatcggcaacatctccaatggctccagcaccgcgcccgtaccattgcctcgtgggtaacgtactgcggcaggtccattatggtgatagccggtgtatagcatctgacggcactcattctcatcacttggtgccataatgaccatgtttggaatacagcgcataaatgaaagatcgaatgcaccttggtgagtctgcccatcagcaccgaccaaaccgccacggtcaatggcaaagagcacgggcaaattttggatagcaacatcatggatcaactgatcataggcgcgttgcaagaaagtcgaatagatggcaaccacaggcttgtagccaccaatagccaggcctgcggcaaaggtcactgcatgttgttcagcgatggcgacatcgaaatattgttgcggatattcgcgcgagaaacgcaccatgccggatccttcacgcatcgccggtgtcactgccattaatttgctatctttggctgcggtttcgcataaccattcgccaaatattttggagtaagtggggaggctgctctggcttttaggtaaggtgccggaggcgggatcaaacttaggtacggcatgccaaccgattggatccttttctgccggagcatagcctttgccctttttagtcatgatgtgcagaagttgtggaccttttaggtcgcgcatattctttagcgtttgcgtcaacgtgtgtacatcatgcccatcaacgggaccaatataattaaaacctaactcttcaaacaacgtactggggactaccatccctttcagatgctcttcggttcgtttcagcagatctttgattggtggtaaggcagaaaatgcttttttaccgccttcacgtaggctggcatagagttttccagataataattgagccaaatggttgttcaggccacctacattttctgaaatagacatttcattatcattgaggataaccagcatgtctgagtgaatatctccggcatgactcattgcttcaaaagccatacctgcggtgatagcaccatcaccgataacgcaaacggtacgtcgccctttaccttcccgctcggcagcaaccgccatacccagacccgcgctgatcgatgtagaggagtgaccaacagaaagcacgtcgtattcactctctccgcgccatggaaaagggtgcaaaccatctttttgacgaatagtagagattcgatcacggcggccggtcaatattttgtgcggataagcctgatgacctacgtcccatatcaaatgatcaaacggcgtattataaacgtaatgtaaagcgacagtcagttcgactacgcctaacccggaagcaaaatgcccgctggatcggctgacacaggtgagcaaatactgccggagttcatcacataacttcggcaagctttcttttggcagcatgcgcagttcttctgggttctccgcaagtgccaatgtcgggtatttggctatatcaagactcattcgatgctcatatcaaaagtgtttatgtagatgcttaactgccatctccatcatccttgatgttattgcgttattcgcggttttcactgttcaggatttactcgctacctggttgcaatggcaataacactggggctattttaaatgattacgttttaattattacgctcaataatgaaacgagctaatgcctgcaatgaatccgtgttataggactgttttgccaattcatccaaggcctctagtgcctcctgataaagatccatcgcttttgtttgggcacaatccagaccaagtagcgccggataagtacttttgcctagttgttggtctgagccttgacgtttaccaattgtagctgtgtcgccaatgacgtctaaaatatcgtcctggacttgaaaggctaaaccgatggcctcggcgtaacgatcgagtgacaataatgttttacggccagcttcaccggctgccagggcgccaaggcgaactgccgcacgaatcaacgcaccggttttatgacggtggatttgctcaaggtcacctaataaaacagggcgagtttctgcttccagatctagcgcctgacccgcacacatccccgcagccccactagcttgagccaactcgataatcatcgataggcgatctttatcagcgacatcgggcatgggggcttcagccaaaatagaaaaggccagcgtttgcagtgcatcaccggccaaaatagcgtgggcctcgccaaacttaacgtggcaagtcggctgcccacggcgtaaatcatcatcgtccatggcgggcagatcatcatgtattaatgaataggcatgaatacattcaattgccgccgccggggcgtctaagttggcgagtgacaaaccaaacatttgccctgtggcatagaccagataggggcggagacgcttacccccgattaccgcaccatagcgcatggcctcgattaaattgctattgccaaacggcaggggagcaatgaaatccagcagagcctgattgactcgctgctgatgagcggcaagttgttgtttaaaatcaacaggtgcatgggtatccgacataaggctactcagtatctggggtaaaaggtttcaacggggcgtcaacatcgtcactcaggagaatttgtacccgttgttcggcttgcaacagggtttgttgcccttgacgggccagttgtacaccccgttcaaattcatttagcgcatcttccagcggtaactcaccggattccaggcgagtaacaatttgttccagctcactgagtgatgtttcaaagctggcggctttgatttctggtgaagcggcttttttcggcatagttttcgtcgactcaatgttttctatggaacgtaacatcaattaacgtaacgttatgaattaatgtagcgtcataaattaatgtcacgtcatagcattccagctaatgagggattttctgggcataacccgccagaacatcagatccgtcgtattcagaccaaaaatttattaccggctattctagcggataacgtgggggaaatcgtggcgtttaggtctggttttagtacgcagtggcacatcatataatgatatactccacggcttgcatattttcgctaacgtttatggccgttgctttcaatagcaacgctatcattccatcactagacaactaaaagccgccatgaagtttatcattaaattgttcccagaaatcaccatcaagagtcaatctgtgcgattgcgcttcattaagatcctgactaccaatatccgcaacgtactgaaacaccttgaggacgataccctcgccattgttcgtcattgggatcatatcgagcttcgtaccaaagatggcaatcttggcccggagatttgtgatgcactgacccgcataccgggtattcaccatatccttgaagtagaagatcgtagctacagcgatatgcacaatatttttgaacaaacgctggaagcctaccgggagacactggttgggaagactttctgtgttcgggtaaaacgtcgtggcaagcatgaattctcttctggtgatgttgaacgatatgtcggtggggggctgaatcaacatattgaaagtgctaaagtaaacctgacccgcccacaggtgacggttaatttggaagttgatcaagacaaactgatcttggttaaggcacgtcatgaagggctggggggcttccctatcggcactcaggaggatgttctctccctgatttcaggcggttttgattcaggtgtatcgagctatatgctgatgcgccgtggctgtcgtgtccattattgtttctttaatctcggtggctcagcccatgagataggtgttaagcaggtggcacattatctgtggaatcgctttggcagctcccatcgagtacggtttatcgccattgattttgaaccggttgttggcgagatcctggaaaaagttgaagatggccagatgggcgtagtattgaagcgcatgatggtgcgcgcagcttctcaggttgctgaacgctatggtgttcaggctttagttaccggtgaggcgctggggcaggtatccagccagacactgactaacctgcgtttaattgataatgcctcggataccctaattttgcgcccgcttatctcccacgataaagagcacatcattaatttggcacggcagattggtacggaagattttgctaaaaccatgccggaatattgtggcgttatttcaaaaagcccaacggtaaaagcggtcaaagctaaaatcgaagaagaggagtctcactttgatttctctattctggatcgggttgtgagcgaagctaaaaatgttgatatccgtgaaatcgcacagcaaagccgtgaacaagtcgttgaagttgaaaccgttgctgaattggccgataccgatgtgttgctagatattcgtgcgcctgatgaacaggaagagaagccactgaaactggatcaggttgaagtgcgatcactgccgttctataagctcagctcgcaatttgccgatctggaccagagtaaaacctatttgctgtattgtgatcgcggtgtgatgagccgtttgcaggccctttatttgcgtgagcaggggtataccaacgtgaaagtctatcgcccttagttttttgataattgacggcactgcgcgttgccattcaggatttgcgcagtaaccgttacggcggccatcattcccgataattataaattcctggcggcaacactagctgccaggcaatttcttccgccttttcccgtccaagtaataaaaacacaatttttagagcgaaatcgatggatgttcctggcccttggctggtgactaaattaacccgtctatcgtagacgacgcgttgatccatccatttatttggggctattttatcttttagtgaggggaaccctgtcatattccctacgggaaataactggtgatgctcgagcaccagtgcgggagccgcacaaattgcggcaaccaaacggccctcattatgggtttgtcggactgttgcaaccagcaacggactatcgcgaaagcactccgcgcctttaatcccaccggggagcactatcacatcaaatttttgatcggcgacatccactaaacgggtatcggccaacagcctcactccgcgcgaacagataatctccagtgcgccatcacccgcgacactggcggttgtgacattgatgcctgcgcgcaccagaatatcaatagttgtgactgcctcggtttcctcgctaccaggagccaggcaaaccagcgccgatacgctcataatcactttccttacgtttgattaattcatacagtcgagcattttctggtaatgccataccatgactacgggcgcgccgcagtaaataaccggttatatagtcgatttcggtatgccgttggctacgtaaatcctgtaacagtgatgaggtattatcggcagtgctccggataacattgttgacatagctgagcagactttcggtggaggtgtgatacccctccatctccatgacgctggcaacttcagcacataaacgttcaatcagctcaggataacgttgtacatcaccattgcggcagttatacagaccggtaagaggattgatgacacaattgaccgccagtttttgccaacaggcagctgagatatcattatgccaagcgacatctggtagcgcctgatggagtgtatcggccagatggttgtcatctattataaccgatgaagttgggccaatatgggtcatgccactggcgacatgaataatcgtattgccgtcccggcgtgcggcatgagtggtcacgccgtgcagaaaaacatgttcattcagtggtaactcttcctgtgtccccatgccgttatgtaacagtaatattttacattctgggtttagtttaggcagcaaggcggtaaccgcactggaaacttgccaggcttttaaacacaccagtaataattcactttgcaacaaatgctttgggtcattcgtagtaagatttcgattaaacgactcaccgtttaacatgatcacattaactgaacaaaagggctgtggcacacgaagccagccctgcacatcatggtcttgctgatgcaacattgaaagccataactgcccgagagctccacaaccaagcacagtaattttcattgggatccccctggtatgaaaagaaaatacactgcttatttttaagcgttatgcattgattatagacttttttttcactaaacgcagggtcagcgataaacgaaacgttaaccacaagtataaagctaacggtaaagatagaggcattgtgcgatagttagcagcttaattttgtctctgggaataaagcggttattatgctcgccatttattttatcaggagtggggaatatgccatctttcgacattgtttctgaaattgatatgcaggaagtgcgtaacgccgttgaaaacgccacccgtgatctggcgaaccgttgggattttcgtaatgtgccagcgagcttcgaattaaatgaaaaaaacgaaagtatcaaagtcgtcagcgaatctgattttcaggtagagcaattacttgatattttacgggctcagttaagtaaacggggtattgaaggtgccgcgctggagatcccggaagagatggcccgtagtggtaaaacctacagtgtagatgccaaacttaagcaaggcattgaaagtgttcaggctaaaaagctggttaagctgattaaagatagcaagctgaaagtgcaagcacagattcaaggtgagcaagttcgtgtcacgggtaaagcgcgtgatgacttgcaggcggttatggcactggtacgtgctgccgatctggggcaacccttccagttcaataacttccgtgactgatattcagcaagtttacggttagccaagggtttgctattgagcctcaaacggtataacgactaaaggggcaacggctttttcatgtctttgccccttaattttggccctataaatcattcttttttaagccgcattgatcaactgttccagttggttgcgattagtctgtttaatatcgactttgacataagcactgcgttccgccgtgaccacgaccgcctcggtaacacctggctgggctttgaggcgctcttccaaggttgtattttttacagccgactctgacaaggtgatgcgcaggctgctaacataaggcggttcttgcatggtgacactgacggcgaaccataccagtgcgataatagctccagccgcaaataccatatcggcaccttcaaggccaaatatccagcccccaagactgccgccaatcgctacgccaataaactgactggtggaataaatccccatggcagtgcctttgtaaccagcaggtgattctttactgatcagcgatggcaaaatagcttccatcacattaaaagcaataaagaataactgcacaccggcaataattatccataggtcttggccagcaaaccacaatacgacctcggcgataaataataccgctacacagcccataaagacctgcttcatgcggcgcttcatttcggcataaataataaacggtactactgcggcgaaagagaccaacatggttaccagataaacaacccaatgttgagcgggcgctaacccagcattagccatcatttgaggtaaggcaacaaagctcgacatcagtaggatatgcaagcacatgatgccgaaattgagtttaagtaaccgactgttgtggagcaccttactcacgctgcctttaaccatgctcgattcacgattgaggacgtggctattggctgaaggaaccacggttaatgtgataacaatgcctaacagcgccagtattgcaatcccccaaaacagagcttgcagaccaaaagcatgcgtcacaattggccccagcaccatggccatagcaaaggtgacaccaaaactgacaccaataaatgccattgctttggtgcggttttgctcacgggttaaatcagacaatagcgccatgacagcggcggcgattgcaccggagccttgcagtgcacggccaagaataatgccccaaatagaatcacttaatgcggcaataatgctacctaatgcaaaaaccagcagcccaccgatgatcatgggtttacgaccgatacgatcagaaagcagcccaaaggggatctgaaaaatggcctgagataaaccatagataccaattgcgatacctatcaatgcctcactggcaccggaaagtgccataccataggtggtcagaaccggtaataccatgaacatgcccagcatgcgtagtgagaataccgtacctagcccccaggtagctcgaagctctagcggagtcattttattatcgttcattgccacctcaaaaaaacattctgcgctattgtagtgatgtttatgccagtcggtaaatctattgatgtttagaatgtatgaccgatgaggctatagagagaaaagaaacacttgtattcgaacaatgttagcctgtttgttcttcaaatagcgtatttcacacgtcgttgattgtaggtgattttttgtaggcatctgattataggtaactaattttcgatggttgatagtagataactgatagtaggtaacagattataggtaactgattatagatggctgctagtcaatcgcggatcgtaaatagctaactgtaaagacaagttggggcaaaaataaataacaagatactgacagaaacagggtagggtacaagtgcacatctgggtacaaatacaaaacagggaacaaatacaaagtggctggcaagagcgattcctgccagccacttgatttatttcactctcatcattttcgctaagactatccagcgtaagtcaggagtactgccgaagagtgtacattgaaatcaactgacatcatgacgctcaatgacgtaatggcaatgatagagaagacaaagagttttctcgcccatacgctgtcattcgttgccttataaccgcgcagtgccatacccagccaccagacgctaaccgcggcagccacaaccagatatttataaccggcatagccacttaatgtcagcatcaaggttgcgaccataaacgccaaaatataaagggtaatatggtttttggtgaccgatatcccttttatcaccgggagtaccggaatgttggcggcctgataatccttaaagcggaagatggcgatggcataggaatgaggcatttgccacagactgaagatcagcaacaagatcagtgcgccagtgtcgaattgccccgttacggcacagtaaccaataacggggggagcggcgcctgacaagctgccaatcaaggtgccgtagactgatttacgtttcatgtagaggctatacaccccaacatagataacgaaaccaataacagccagcatcattgctaatgcattagctgccacgtagagcaacagcatgccagcaatacccagtaccgatgcataaatcagggataccttcggatcgataagccctttgaccaggacacgattcttcgttctctccatgattttatcgatatctcgatcgatatagttgttaaatacgcacccggaggcaacaactaacgagacacctaataaggtggagagaaacagggggtaatcaatatcgcccttggaagcgaggagaaaacccccaatgacagaaattaaattaccgaaaataattcctggcttagtgacttgcaggtattgcttaatcatcacatgcagctcttcagtcaaccatcatattgatgttgaggttgtacataatccagagtgagcccactacaacgattgcaataatcatagcggtgaacaggagcgccaccagattccagcgttcttcagacgaagtattcatatgtaagaagtacactaaatgtacaacaatttgtacaacagctaaaccgaccactgtgagcagagtcgttgtataggaagcggtaccactcatcaccataacaaatggaataactgttaggatcaccgacagcacgaagcctataatataggacttcaagctaccgtggctggctccaccgtgagtagttgttgaatgactcattatatggctcctaacagatagactacggtgaatacacagatccagaccacgtccaggaagtgccagaacaaactcagacacatcagacgggttctattggttgagttaagaccacgtcttgctacttgaatcatcataataatgatccaagcgaggccagcggttacgtgaagaccatgggtgccaaccaaggcaaagtaggcagacaagaacccactacgtgccggaccgtaaccttcttcaatcagtttatggaattcgtagagttccattgcgataaagccaaggccgaacaggaaggtgaagcccaaccaggtattgacctgttttacactccctttgctcatgcccagcatcgccacgccgtaagtaatactactgaaaagcagcaggaaggtttcgaccagaacaaagttcaaatcgaaaagttccttgcctgaaggaccgccagcggtcccatttaccaggactgcataagttgcgaacagcgtcgcaaacaaaatacagtcgctcatcaggtagacccagaagccgaatactttcgtcgctcccgcatcgtgatgcccatgctctgcatgggctacgttgtggttagtcagagtttcagttgacatgattcacgcctgctttgctgatttgttcatgatgaagattttcgatgcgctccacttcagccgctggcacatagtaatctacatcctcgtcgaagcttttcacgatccaggtaacgatcatgccaacgaagccaataatggctagccaccagatataccagaccatagcaaagccgaaaatcaagctgaagccagcaataatcacacctgcaccggtattcttcggcatgtggatttcttcgtatttcgctgggcgcttataggcctcgcctttctctttcatgtcccagaactcatcacggtcaacaacgttaggaacgacggcgaagttatagaacggcggaggggaagaagtcgaccattccagcgtacgggcaccccatgggtcaccggtcagatcgcggttttgttcgcggtcacggatactgacgaatacttggataacctgacacaagataccgcaagcaatcagtgctgcaccaccagcggctaccatgagcatcgtatggaattctgggttgatgtcttggctcaaacgacgggtcattcccataaagcccaatacgtacagcggcataaaggcaacgaagaaaccaataatccagaaccagaatgcacggataccccatttctcattcagcataaagccgaatgatttaggccaccagtacgtcaggccagcaaagcacccaaatactacaccaccgataatgacgttatggaagtgcgcaatcaggaacaggctgttatgcaggacaaagtttgcacccggcacggccagcagaaccccggtcatcccgccgatagagaaggtcacgatgaagccaatagtccacagcattgcggagttaatctgaatacggccttggtacatagtgaacaaccagttgaaaattttcacccctgttgggatggaaatgatcatcgtggcaataccgaagaaggcgttaacgttggcaccggaccccatagtaaagaagtggtgtagccaaacaataaacgacaggacggtaatcgcgatggttgcccatacgagagaggtgtaaccaaacaggcgctttcttgagaaggttgcggtaacttcggagaagaccccgaataccggcaacaccaaaatgtacacttccggatggccccaggcccaaatcaggttgatgtacatcatcatgttgccacccatatcattggtaaagaaatgggtgccaaggtaacgatctagcgtcagtaatgcgacggtaaccgtcaggattgggaaagaaacgataatcaagatgttggtacaaaatgccgcccaagtgaagaccggcattttcatcatcgacatgccaggtgcacgcatcttcaggatagtcgcaaagaagttcacacccgttagcaatgtccccagaccggagatctgtaggctccatatccagtagtcaaccccgacaccaggactgtattcaataccggatagtggtgggtaagctagccagccagtctgagcaaattcaccgactcccagagagatgttaattaacaccaccccaacggcaaagagccagaagctcagagagtttaggaacgggaaggcaacgtcacgtgcaccgatttgtagcggtacaactatattcatcaagccgacaacgaaaggcatcgccatgaagaaaatcatgataacgccgtgcgcggtgaagatctgatcatagtggtgaggtggtaggaaacccgcttcgcccgcagaagcaagcgcttgctgactacgcatcatgatggcatcagcaaaaccacgcaacagcatgaccatggcaaccagaatgtacatgataccgatttttttatggtcaaccgaagtcagccattcgctccacagccatttccacttgccgaaataagtcagagcagcgaccagtgccgctcctccaataataattgcggcaacggtcaccattatgattggttcgcctaatggaaccgcatcaagtgttaattttcccaacatcgttttattcctcggctccggcgtgagcagtgtgttcgcccatttccatgccctggctcatatccatgccttttggcatgtcatggccattttttggcatgttcatatcgcccataaacttaccaatgattcctttaaatagtgccggtttgatactggagaagtattccaccgggttattttcactgggcttagccagtttctcgaaatcgttagttgtattcagggtgttcggcgattttttcacttgttcgacccattggttgaagtcttcctgcgttggtgttgcgattgcagtaaatttcataccagagaagccttggccactgaagctaccggaaataccgttgtatttacctggttcattggcaatcagatgcaatttggtctgcatcccggccatcgcataaatctgcccgcctaactgagggataaagaacgagttcattactgagttggacgtgattttgaagttcaccggaaccccagtagggaaggccagttcatttacggtagcgatgccttgttctgggtagataaataaccatttccagtcaagggagaccacttcgatggtgatcggatctttacccgccacaacgataggtttgaatggatcaagttcgtgggttgttttccacgttatcgtagccaaaatagcgatgataatgattggaacagcccaaacaacaagctcaattttgttggagtgggaccagttcggggtgtaagttgcacttttgttggaggctcggaacttccaggcaaaagcaaacgccataaaaataaccggaataacgacgatcaacatcaaaccgatagcagtcagtatcagcgttttttgttcgactccgattgcgcctttgggattcatcaataccatattgcaaccacttagcatgacggtggctgcaaataaagacaatattcccatatttttaatgtatttcttaagtctcatctaacgacctcaattacaaaatggctctattgtcgtttcatgtgtgcgggcattttacgggaaggttgcaggactgtaaacatgcttaatattctgtcagcgccttgttgacactttatgttaagggggtcacagatgtgaccttatttggcaattttccagtagcaacaatatgttggcgatactctgtggttagaaaatcatgaatgttaaggaaaaacaacgttcattggcatttttgttcggagaaaatagtgatttttaattggggtgcgaacttatttcgtgtgaataatatgtaatacaaaggtaaattaaaatatatttcgaggtgtcctaaataggcacctcggaatcatttagttatagttagaaattatatttaattgagtaaacgataccatcttgtaaaaagtcttcacctaattttttataggcataacggtattgaataccggtagtaagcggcttaaccggtgtccaccacaatgcgatagcgccgttgataccatttttcccgccattgcctgctgcataggcttctgcacggttaaattccagttcattccagttagtgatgctgaatttttcatcgaaagccgtgaagtcatagccagcaacccaaccaaccacatagccgttgttacctgaatagtaagtttgatcaacatagtgcagggcaacaaaaggttttagccacagagcatcgaaagcagcgttatagccaatcccatacagtgtatttacttcatggaagtttctgttatcccctggcagagagtatgtaccgtaaacatgaccataaaggttaaaaccgctgtcacccagatagtagcggccagttgttttaaaggtatagcgttgattatcacctggttgggctgtttttgaattgaaggggttttctaaatcgaagaaaccataaacttccccccaactgaagcctgccccgccttctaactcaatataggcaaagtcatctttatgcgaggaatcacctgatttatgcgtagtgcttctggtccagtcaaggtagttcaagctgacattaccgaacccccattggtattcagcttggacggatggcgccaaagtcactgttgccagcgctgcagtgccgataagaattttacgcataaatgcctctgtgtagatgaaaaatattaaggaaaagcgaagggagtgagtccttagcaaaaagtgcgctcatcatagtctcggagcacgaaaggataaatggtttaaggtgatatgcatctcatttttttaaaaaaaacatgcaacaaacatgaaaagttgtgatttacgccaatgaattgaaagtgaggtatttgtggggtttatttgtcaggtttgtttttcggataaacacaaaaaagccagtgcacaaactgaacagcaccggctttatgtcacttatgtgatttactaggctagtttttgccgtctgagcgctaaataatccagcagccccccgagagtcatcccgacgatgctgaactgaatccccctcaagagtaaggtatcggccacttggggtgcagaggtccaatctagtgcgttacatatcaacaagattagccacacagacagcaacagaccgccaataatgagtaaacgtagtgcccaacggtaagccgttttaaatgcgatccggggcataaattcgtcggttttctgcgtatgatccagcgtttgacggcagacatacagtagcaatagccctggaatggcggcggcaatagagaataaatagaaaagtggccagccatgggcctctacaaaccaaccggcaatcgggccaacataaacccggcccacagcagagagggccgataagagggcaaactgtgtggcggagaaggacttgttacagagtgtcatgagtaatgcgacaaaggctgctgttcccatccctccgcataagttctccaaaaatatggcactgcccatggagaatatatttttatcagtgatagcgagtagccaatagcccatgttagaaactgcttgtaaaataccgaaaatcattaaggcacggaataagctcagccgttgcattaataggccgccatagagagcgccaataatcgtggcgatcagccccagcgttttattcaccaaccccacttcaccggcatcaaacccgacgccacgtatcagaaaagttgtactcaggcttgcggcaaacgcatctcccattttgtaaaacacaataagcagcaagatcagccaagcattattacgaccaaaaaaatcacgtaatggagcgacaatggcctgctccaatgtttttggtggggcaattcggatatcgggttcaggggcgagcaaggtagcgaataccccaatcaacatcaatccggccattagccaataagttgattgccagccaagatagcgatctgcaatccacaacgctaacccaccggaaaccagcattgccaggcggtagcctagtaccgatactgccgcccccgtaccgcgctcttcagtggtaagcaagtcagttttataagcatcaaaaacgatatcttgagaagctgaacaaaatgcgactaataccgcgaccgctgccagccaccataaatgtttggcaggctccataaagcccatcgcgataatggcaataatgagtaatagctggcttaccagtaaccaaccgcgccgacgccctaaaaaggacggcgtgtagcggtccatcagcggggaccaaagaaacttaaagacataggcttggccaaccagcgagaaaataccaatcgtcttaagattgacattttccacggtcatccatgcctgcagtgtgccactggtcagcgctaaaggaaggcctgaggcaaagcccaataacagaagaatgatagagttacgttgggtaaaaaggtttgaatagcgattgggcataataaatctacctgctctgccgcaaggtatcgggcagagcattctgttgagcaactataattatgctaagtgaaggttatagttgtgttgagcaaaaaaaccaagcaaacaccaaattagcgtgcattttgtttgatgaaactactgacgctagtgtcttgcgccatatcggcaatgacgtcacttaacacgctatttacagcatcggtgattttttcgttagttgccgtaaatgctccctgaacattgtaggtcgcgcggtagttttttacctgcttgttgccgtttttcgccgttgccgtaattgagatatcggctttggtagtgatgttgtagcgcaagttaccttcctgcacatcagcatacaattggttaaccacaatttgtaggtcaaccgcaccatcagcaccaatcatataaccgcgggccgtcatttgtttttcgagaacctcctgtaacaggaagcgcaaatcacgtgatggtgttaacaccactaattgcccatcgcgattaactttagccagcgcagcgtcctgacgctgatccgcgccattgatactgatagtcacacccatcagtgttggatcttgtgttggcaataccacttttggcgtgacattcagcgtgttactcgtggtagcacaaccggccagtataaaaatagccaacagcgggaaaagaattttctttagcatgttcactttctcgatagttatggaattctttaataatcagagcaggatagctgccatattattttgcgaatttgcagtcgccccatcataacactgccattggctgggggaagaacctgatgaacagaaattcatctgaaagccgattttctccctagatgcctcaatttttacttaaaacactgacaaatgaccttttcatctgactacctgattagcatcatgcggtatacagacaaaagaaatttatccaggatattttgtatctaaaatgttataaaaccgcagggttcggctaatattacaagtgagtaggcagttttctgtctcggcagtaaggagagcaacatgattttgattcgggaacaaattgaagaaaaactaaaagcggcattcgtaccggatcatctcgaggtgattaatgaaagctatcgccacaatgtgcctgccggctctgaaagtcattttaaaattgtgatcgttagcgataagttccaagatcagcgttttctgagccgtcaccgttctatttatagtgtgctggctgatgagcttgcaggcagtgttcacgcgctggcgttacatacttatacacggaaagagtgggcaggattacaagataccgtaccagcatctccctcttgtcgtggtgccaatacactggcttaatccataaacaggcttaatagcagtagtcattctggcctgatttagggtattagtagatgagaattttacaaacggctctagggccgtttgtgtttctgtataggcgacatcttcatttaatcgttgcgccataggagtttttgccgagggaacgactcatgcgtgaattttaccgcgacaacattcgcttgctttcctcgactcataacctatgcgccgctataatgtcgcgtcttatttttccggaatggtttcgggacgcttctgacatctgggatactcggttctgtaatgcggccgtcccggttcttggagggtgttttcagagttcgcatcattcctgaaaaggtaatggtgctgcttcgtttgcagcttctggagttgaccgagcactgtgatttttttgaggtaacaagatgcaagtttctgttgaaaccactcaaggccttggccgccgtgtaacaattactgttgctgctgacagcattgagaaagcagtaaaaagtgaattagttaaagccgctaaaaatgttcgtatcgacggtttccgcaaaggccatgtgccgatgaatatcgttgaacagcgttacggcgcctcagtacgtcaagatgtactgggtgatctgatgcaacgtaatttcgttgatgcgatcatcaaagaaaaaatcaatccagctggcgcgccaaactacgtgccaggtgagtataagcagggtgaagattttacttattctgtcgagttcgaagtgtatccagaagtggaactgaaagatctggaaagcattgaagttgagaagccagttgttgaagttaacgacgctgacgttgataccatgctggaaacactgcgtaagcaacaagctacctggaaagaaaccgacgctgcagcaacggctgaagaccgcgcgactctggatttcaccggctctatcgatggtgaagaatttgaaggcggtaaagcgactgatttcgtgctggcaatgggtcagggccgtatgatccctggtttcgaagaaggtgttatcggccacaaggccggtgaagaattcaccatcgacgtaaacttcccagaagattaccacgcagaaaatctgaaaggtaaatcagctaaattcgccatcgtgctgaagaaagttgaagttcgcgaactgccagaactgactgaagaatttatcaaacgttttggtgttgctgatggttcattggcaggtctgcgtgctgaagtgcgtaaaaatatggaacgtgagctgaaaggcgcggtgcgtaaccgtgttaaaactcaggcaatcgacggcttggtcagcgctaacaatatcgacgttccaactgcactggttgatggcgaaattgatgttctgcgtcgtcaggctgcacagcgttttggtggcaacgagaaacaagctgctgaactgccacgcgaactgttcgaagaacaagctaagcgccgtgtcgttgttggtctgctattgggcgaagtgatcagccagcatgagctgaaagcagatgaagatcgtgttaaggctctgatcgaagaaatggcatctgcttacgaagatccacaagaagtgattgagttctacagcaagaataaagagctgatgaataatatgcgtaatgttgctctggaagagcaggcagtggaaacgctgctggctaaagccaaagtaactgaaaaaccaacgactttcagtgagctgatgaatcagaccactgcagcgtaatgtttttcagcgcatgatgctggatgggacccattcagtattttgattgattaagcccgtcgccattattggtcacgggctttttcttttggtaacaataatcacttaatagtatgattcatctgacatgtttcgttgtaatctgcgctatatttaaaaaagtaaaatgaagcacttagcaactaaataattaattgggtgtcgagattacagtagggataagagttggtcgttagataaaaggtacccgtggggcttgaaaacacgtattgatcccccaattaagctaacagacgtttatataagatgtgatgaaacactggctgattatcattgtcgaatgagtctgggaggccaggcgttttgtatgcgaccttgttgcatgaacatagtcatcattacttatctcaagtagaatcggttatgaatggcgccaaagtaaattctattaggagacggtaatgtcatacagtggcgaacgagatcaatttgcacctaacatggctctggtgccaatggtagttgaacagacttcacgtggggagcgttcttacgatatcttctcccgtctgttgaaagaacgcattatcttcctgacaggtcaggttgaagaccatatggctaacctaatcacagcacagatgctgtttttggaagccgagaatccagaaaaagatatttttctgtatatcaactccccaggtggggtgattactgccgggatgtcaatttatgacaccatgcaattcattaagcctgatgtcagcactatctgtatggggcaagcatgttcaatgggggcattcctcttgactgcgggtgccaaaggtaaacgtttctgcttgccgaattcgcgggtgatgattcaccaaccgttgggcggtttccagggacaggccacagacattgaaatccatgctaaagagattttaaaagtgaaatcgcgcatgaatgaactgatggcatatcacacggggaaatctctcgaagaaatagagagagacacagagcgtgaccgtttcttgtcagcagaacagtctgtagaatatgggttagttgattccgtattcacccgccgtgactaacgacttatttctgcgagccgatatactatagtgtatgtaaatagaacaaattatgggatcgagtagatgcaatcgcgtgttgttcgaatactccctggtatatcggctatccgttgaacgttaacgtgatgtccagaaatagcgagaatagtctccctgccaccatagtttcgggtgtggcagatactaaagaagaggtttactgatgacagataagcgcaaagacggttcaggaaagctgctgtattgctctttctgcggcaaaagccagcatgaagtgcgtaagctaattgccgggccgtcagtgtatatctgcgatgaatgtgtcgatttgtgtaatgacattattcgcgaagagattaaggaagtttccccgcaccgggatcgcagttcactgccaacaccgcatgaaattcgccaccaccttgatgattatgtcatcgggcaggaacctgcgaaaaaagtgctggcagttgcggtgtataaccactacaagcgtctgcgtaacggtgataccagtaatggtattgaactgggtaaaagtaatattttgctgattggtccgacagggagcggtaaaacgctgttggcggaaacattggctcgcctcctggacgtgccatttactatggcggacgcgactacgctgactgaagctggctatgtgggtgaagatgttgaaaacatcattcagaagctactacagaagtgtgattacgacgtacagaaagcgcaacgtggtatcgtctatatcgatgaaattgataaaatttcacgcaagtctgataatccgtcgatcacccgtgatgtctcaggtgaaggcgtacagcaggctctgctgaaattgatcgaagggaccattgctgcggtaccgccacaaggtggtcgtaagcatccacagcaggagtttttgcaggttgatacctccaagattctgtttatctgtggtggtgcttttgccggtttggacaaagttattgggcagcgtattaataccggctcaggtatcggctttggcgcagtggtaaaaggccaatcagaaaaggcaacagaaggtgagttgctgagtcaggttgagccagaagacctgatcaaatttggcttaatccctgaatttatcggtcgtttgccggtagtcgccacattgagcgaactgagtgaggacgcactgatccagatccttaaagagccgaaaaatgcactgaccaagcaatatcaggcattattcagccttgaaggtgttgaactcgagttccgtgacgaagcattgactgcgattgccaagaaagcaatggcgcgtaaaacaggtgctcgtgggctgcgctccattgtcgaaggtgttttgctggatacgatgtatgatctgccatcaatggatagcgtagagaaggtggtcgtggatgaatcagttattgctggtcaatctgcgccgatgctgatttatggtcagcccgaagcgcaagcttctggtgaataattaaccagattgtccaggcagttagtatgacaatgggggattttatcccccatttctttttcctcgcattgttatcgttgaatgtaagacattcgtccccatatactcaaatacctatttagtgaaactcgtgatgactcgtgtttcacgagatttccagtaatctggcggaagctaaactaagagagagctctatgaaccctgagcgttccgaacgcatagaaatccccgtattgcctctgcgcgatgtggtggtttatccgcatatggtgatcccactatttgttggccgggaaaagtcgattcggtgcctggaagctgcgatggaccatgataaaagaatcatgctggttgcgcagaaagaagcttcgaccgacgaacctggtatcaacgatctgttttcggtgggtaccgtagcctcgattttgcaaatgctgaagttgcctgacggcacagtaaaagtgttggttgaaggtttacagcgtgcgcgtatcaccacgctttctgacagtggcgagcattttgctgcccaagcggaataccttgaatcacccgtgatggatgatcgcgagcaagaagtcttggtgcgtaccgcgattaatcagtttgaaggttatatcaaactgaacaaaaaaatcccgccggaagtgctggcttcgctgcacagtattgatgatgcggcacgtcttgctgataccatcgctgcacatatgccattgaagttaaatgataaacaagctgttctggaaatgttcgatatcaccgaacgtctggaatacttgatggcgatgatggagtcggaaatcgatctgttacaggttgaaaagcggatccgtaatcgtgttaaaaaacagatggaaaagagccagcgtgagtactatctgaatgagcaaatgaaagctattcagaaagaactgggcgagatggacgatacgccagacgagcatgaagcgctgaagcgtaaaattgaagcggctaaaatgccgaaagatgcgcgtgaaaaaaccgaagcggaactgcaaaaactgaaaatgatgtcgccaatgtctgcggaagcaaccgtggtacgtggttacatcgactggatgttgcaggttccttggaatagccgcagcaaagttaaaaaagacctggttaaagcacaagaagttctggataccgaccactacggtttagagcgtgttaaagatcgtatcttggaatatctcgcagtccagagccgggtcagcaaaattaaagggcccatcctctgcttggttgggcctcctggggtcggtaaaacctctctagggcagtcaattgctaaggcaacgggccgccagtatgtgcgtatggcattgggtggggtgcgtgatgaagctgaaatccgtggtcaccgtcgtacgtatattggttctatgccgggtaaattgatccagaagatggcaaaagtgggtgtgaaaaacccactcttcctattggatgagatcgataaaatggcatcggatatgcgcggagatcctgcttctgcactactggaggtgctggatccagaacaaaacgttgcatttaacgatcactacctggaagtggattacgatctctcggatgtgatgtttgtggcgacctctaactccatgaatattcccgccccgttgctggatcgtatggaagttattcgtctgtccggctataccgaagatgagaaactcaatattgctaaacagcatttgctgccaaaacaatttgaacgcaatgccatcaagaaaggtgagttgaccattgatgacagcgccattatgagcattatccgttactacacccgtgaagctggggtgcgtagtttggaacgtgaaatttctaaactgtgtcgtaaggcggtaaaaaatctgctgatggacaaaacggttaagcacattgaaatcaacggggataacctaaaagatttccttggcgttcagaaggttgactacggtcgtgccgatactgaaaaccgcgtaggtcaggtaacgggtctggcatggactgaagtgggtggtgacttacttactatcgagaccgcttgtgttccaggtaaaggtaagttgacttataccggctcactgggtgaagtgatgcaggagtcgattcaggcggctctaaccgtggtacgcgcgcgcgcggataaattgggtatcaaccctgatttctatgaaaaacgcgacatccacgtgcatgtgccggaaggggcgacacctaaagatggcccgagcgctggtattgcaatgtgcacagcactggtttcttgtctgacgggtaaccccgttcgtgctgatgttgcaatgacgggtgagataaccttacgtggcttagtattgccgattggcggtttgaaagagaaattactggccgctcaccgtggtgggatcaaagtggtgttgattccagatgataacaaacgtgatctggaagagattcctgacaatgttatagctgatctggagatccacccggttaaacgaattgacgatgttttagccattgcgttggaacacccggcctttggtgcccagccagtagcgccaaaatagtgacggatcgcaagaagtattgataaaactaatgctggtaagtgaaatcctgcttgccagctattttttgtgccgctaagttagttcggctgtccggcaaaattttaagctcttgggctgcttgccaaggttggacaggattgatataacagccgcgctgtcgtgttgtccgtagggattttcggcgcgacgatagaattctaaaggggatgaaagagtgaataagtcacaactgatagacaaaattgccgcaggtgctgatatttctaaagcggccgctgggcgtgcgttagatgcaattattacttctgttactgaatccttgaaagaaggggatgatgtggctctggttggttttggtacttttgcagtacgtgagcgttctgcacgtactggccgtaacccgcagacaggtaaagaaattagtattccagccgctaaagtaccgggttttcgtgccggtaaaggcctgaaagacgcagtaaactgatttgcgtcaaatatcacctgtggcaaatattgtttgtgttaaacaataacctgacgcagttgagctggtaaggtaagatacaaggcgcatcgtttatgatgcgcttttttttcgcttagccactgaactgacgtaaaatgccagtctggcgaaacaaccttagtggctggctaacggtaataaaagcacagtaagcagttttaacgcgcagcagcacgaagggctgtcgcaaggaatgctggttttatttagacctgcgcaagagttttaatccacattacagcggagtattgtcacattatgatggacaatttacgcgcggctgctaataacgtcgtgctcaaaatcattctggccctgatcatgttgtcctttatcctgactggggttggcagctatttgattggtggctccaacgattacgcagccaaagttaatgaccaagacattagccgggctcagttagaacaggctatgcaaagtgaacgtggtcgcctgcaacaaaaattaggtgaacagttctctgtgctggccgcgaatgaaggctatatgcaacagttgcgtcagcaggtgctggggcaattgatcaacaatgtgttacttgaccaatatgctagaaaattgggtctgactgtcagtgatgaacaagtaaaagagtctatccgccagatacctgatttccaaacaggtgaacatttcgacaataaccgatatctcgcactgattaaccaactgggctacaccccagagcaatttgctcaattacagcgtcagcagttgatcaaccagcaattgctgaaagcctttagtgataccggttttgtgctgcctattgaagtgcaggcaatgtcagcgttggttttacaacaacgtgatgtccgcttggctactttggacctcaaagcacttcaagcagagcagaaagttactgatgaagagctacaagcttattacgatcagaacaaacataatttcattgcaccggaacagatgaaagtcagttttattgcaatggatgcagcggcaatgcagagcaatatcacggtgactgaagaggatattgcagcgtattacgatcaaaaccgcagcagttacacccaacctgaacgccgtaattacagcgtcattcagtttaaaacagaagccgaagctaaagcggcgcttgatgagctgaaaaaaggtgctgattttgctgtgatagctaaagaaaaatccaccgatattatttctcgtaataatggtggcgaactcggttggctggagccagaaacaacacctgatgaggtgaaagctgccaatctgagcgagaaaggccaactgtctgatgtgatcaaatcttctgtcggttatttaattgttcgcttaaatgatatcaaaccagaattagttaaaccgctatcagaagtgcatgatgagttggctaaaaagcttaagcaggaaaaagcgcttgacgcttattatgcgctacagcaaaaagtcaatgatgcggcaactagcgataacgaatctctggcttcagccgaagaggtcgcggggactaaagctcaacaaacaggttggttcacccgtgacacggtaccggctgaaattaatttcaaaccggtagtccaggcaatctttgatggtcgcctggtgggtgagaacggttctgcggggagtaactctgaggttattaccgtggatggtgatcgtgcttttgtcatccgtattgatggtcacaagcctgaaggtattgagccattcgatcaggttcgcgatcaaattagtgagctggtgaaacgccaaaaagcggaacaacaggcgcgtgtcgatggtgaaaagattctaaccgcgttgaaacaaggtaaaggcgaagaagcgatgaagtccgcgggtatcagcttcggggaaaagaaaacgctgtcatatgcatcggttgatgatcaacttatgcagacaatcttcgctctggcgcatccacagaaagaccagccggtttatggtttatctcaggaccgtcaaggcaacatcgtattgatcgagctgttatcggtgactccgggtaaattgcaggaaagtgaaacgaagatctttattgagaagatgcaggaagagtccgttagcatgatatttgatgcgttgatggctaatctgcataagcaggcaaccattaaaataggccctgcagagcaacaacaaccgcaataagcttcgcattcatttgcaaaccgatgtaataaaagaaaggtcgctttggcgacctttcgcatatctgtgatctgccctttgcgttgagccaaggggtacggcaaggtagccatgctgtcaaacacaaggaggatacagcatgaaatttttaggaaaattattcgccataaccgtattactaacgggtctcaatattcattctttcgcttatgcggcccctgccgcttccacagataatacgcaggataaagtctcaaaaaagtcgcctaatagcgccgcagataacggcgctaaagtaaaaggtacgccagcacagtcggtagagaagataagtgataacactaaaaatgtagcagcagattcctcggttaacgcatcagacaaccaacaacaccagatcaatattaatagcgctaatgctgaacagttagcgcagttcttgaatggtattggcagaaaaaaggcggaagcgatcattacctatcgtgaacagtcggggccattcacacatgtggatcaattactcgaagtgcctggccttggtccctctttcttggagcgaaataacggcaagattaaattgtgatgctcttgttgtaagggaaccccctgatgcttcctggtgagtttcataggagccaaagcggtatctggattataaaagtggtatatggattataaatagagcagtaagttggtaaatcaagccgccaggcggtgctggccatcggtaggtattggtctggcggcttttaccaacataattattagcattttattaggttgattagggcggtgatttaaaactgtgattctgatcaaggttatacagtgagcatgctatgcagcaattttcgtctgctaatcttgtcttgaggtcctaccagttttgttggtaatcctctcacatttattcacagattggagaagctcatagccatgcacacccatattaaagtccggggtttccatattgatgtttttcaacatgttaataatgcccgatacttagagtttctcgaagaggcccgttgggaatggctggatgggcaacccgtattccaatggatggttgagcaccaaattgcttttatcgtggtgaatatcaatattagctaccgtcggcctgctgtattaggtgacttgctacgtatcgatagccagttacttaaactaaacggtaaaagtggtgtgatgaagcatacgatcacgcttgaaccaacggctatcccggttgttgatgcggaactgacatttgtctgtattgaccaacgtagccagaaagcattgccgctggaaggtgagttgcgtgaaaaactggaggagctagtcaatcggggagcttgatattaatcctaaacggtggttgagaaggggaacggttattgagagcgtgtgttgcggccatattatatagataggccgctatatatcaggctaaccccaccttttgctttaggtttaatataacctgctgtttattcgccatataggatgccaggcctttagcccgtaggtgacacgctgcacattggccacagccgtctcctttaattccgttgtaacaggtcagtgtatggtggcgaatgagatccaattgttgatagtaatcggctagtgcccaggtttcggctttatcaagccacatcaggggggtgataaaagcgatatcccggccaatacctaaatcgatagcgtggttcaatgccttaataaactcatcgcggcaatccggatagccagaaaagtcagtttcgcaaacaccggtgataacggcctgggcttgcacttgatacgcataaatagaggctaaggtgagaaacagtatgttacgtccagggacaaaagtactgggtaatgcaccgtcagcgttggcatcatatgacgggacaggaatactgtcacgagtcaggctactgacggccagttcgttcaacataccgacatccagtactttatgtgctgtggcacctagttggagtgcaagttcgcgagcaacatctatttccgtacggtggcgttggccgtaatcgaaagtaatgcaatgtacttcgtcatattgctgtaacgcttgaattaagcaggtggtggaatcttgcccaccactaaagacaactacggcacgtttcattcggtaacctcgtacggctgcaggtaacaatgattgggctaaccctgcagcataaattaagaactggcagtatgttactcagttaacacgcagaagggtagtcaccctccattgggttgcttgtcattatgcttttagcattagagattagagccggttgctgattatgattgctatgccgctatgccgctatgccgctatgccgctatgccgctatgccgctatgccgctatgcccgcttaacgttatagctaatcatctatgtaatgttatcgctaattacctattaggttataacttgcagggtagccattaattcgttattggcggtagccaggcttgacagaaatcgaaccaaccatatgccgttaatgtaaccccattgatgcgtgatggggcattgacctgatattcatagttaaacagcggcaaaatcagtcccgctaacatcaggtcatcgtaatgtgcctgtaattggcgaaaacgttctggcgcgctttctatctgctgaatgaaggtcagcgttttttgctgctggttccactgttcgttctgtaaaattccgcgccacagagggtccagccgtagccagctctccattgtggcctctggcgattcaccgactaaatgatcggccaaaagtaaatcgctctctttaattttgtcaacatcttgccactgtttgtcatggcaggcgcggatctctaatgtacagccatgagcggctaatactatttttagttgctcagcgacactctcaagctccatcggcggttgataggtcagaaccaaacaggcgggaagggagggattttcatccgtcgaaaactgtggaataggccagcctggaaggatttcatggcagggcgttattacgtcacggctgatggagagcgcctctaatatacccgaggtttggactaacatcagtagcttggctatttgctgtggagtgaggttgctacgatggcgattaatagccaggtagcagaatccgaggctcatgctgcgctgtacggggcgggccagtgggaactcttcctcttggccgatggtgatgcgaaccggatgctggcaactgccatttgttgaatttaccgtcaggctaggggtgatccagtactcgataatgtccagatagggatgttgcaaatggtaaaattcgtgctgctttagtcgaactaaatgtttatcaaaggtcgctaatttaaaaggacccgcacctaaaaagggatcgtctggatgaaaaaacctacagggtaaatcagccagccggtgtgctagccaataatctggttgggaaagggtaaattgtaggcataaagcgtgggggagagtgatagtaacaatattagcaaaactgggttggctacgtcggtttgcgcgcagaatctccagtgtttgcaataattgcttaccatgaatgtggtcgccattatgccaacgtagttggctgcgtaagaagaactgccaggttaagccatctgcgctgatttgccagtgatgagccaaatcaggtttaggcaacgggtcacctgtattaaaccgtgtcagcccagcatgcaaagtataaatcaggtgctgttctgcccgccctgtagcattcatgggattaagcggttccagctcgcggtagtaggggatacgcagaatagggctatcggcttgccattgtccgcccatatggggggtaagtaaggtctgtaggcgctcgggttccaattgtgctattgagaatgccgcctgatgatcgccttgctcaaggaactgttgcaggtaaatagcccgtaatgcatcaggttttttcaggcattgcagttgcgctcgtttccctctacccacttgtgaatgccagcttagccaactcttcatctgtagttgctgaatcagggtgcgggcatgccgttcgctacaaaagagtaaactagccacgtcagccacggtagtcgccaccgggtggtcaccaaatttttgatataaacgctcatattgggtaagccggtgaataatgcgcataattaaatccggaatagtttaaattatttgttcactattagttccgtaaatactacgccataattttatccatgccaccggtttcatattttacgaggttttgaatgtaccgtttagccgcttttgatatggatggaacgttgctgatgcgtgaccataaaataggtagcatcacactgaatgcgctgcatcaattagccgatgctggggtaactctgaccttcgcgaccgggcggcactaccttgatatgaaaggcatattatcccattcaggcctaaatggttatttgattaccggtaatggcacccgagtctgcgatgctgagggtaatcctttatacggcatggacttaccggcagagttggtggaatttgtgctgcgtaccccatggcagacaaatgccagtattcaccttttccgtgatgatggctggtttactgatcgtaatgatcccgatctgctgatagcacacactaccagtggtttccatttccagcttaccgaatgggatgagttgcctctaaccggtaatcacaagttctgttttattgtttcacatcaggaacttgtcgaattgaaagcgcaattagagcagcagatgagcggtgaagctgatttctgtttttcagcgacggattgtcttgaagttttaccccgtggttgtaacaaaggggtggctttagaaaaactaagccaccatcttgatttaaccttggctgactgtatggcattcggcgacgcgatgaatgataaagaaatgttgtcgcgcgtggggcgtgggttagtgatgggcaatgcattaccgcaattgaagcaagaattaccccagttacagattattggtcgctgtgagcaacaaggcgtcgcccactatttgcaccattggctaagttcaccacacctcacctattcccccgaattctgaggtgatagctattagccagccggagaaccatccggtttttttcttccgtaggcggtttgtcagtgttcatgcctagctgacaaaccgcttttatctctttgaaattggacgttactgaaactgaaagttactgcaactggacattaatgaaacttaatgccactgcagcgttattcgcgctcattcatctgaatcacagatatatattcgcctacagattattcaattcattggtaaatggtgttaaatccccaatgttattgctgacccattcctcgttataataggtatcaagataacgttcaccactgtcacagagcaatgtcacgatagcgccagatttgccttgttcacgcatctgttttgccaattgcaatgcaccccagacattggtacccgttgaggctcccactttacggctaagaatactctccagccaacgaagagtggcgatactggcagcatcaggtacgcgtagcatgctatcaatcacttctggaataaaagaaggctcagcacgtggacggcctatcccttcaatacggctaccacaacggcccgtgacggtgcggtcacgggtacagaagcaatcataaaataccgagttttccgggtcgaccaccaccaactgagtgtcatgtccttgataacggatataacggcctaaggttgctgaggtgccaccggtccctgcgctcatcacaatataatctggggttgggaaaggctcccgtgccatttgacggaaaatgctgtctgcaatattgttattgccgcgccaatcggttgcccgttccgcataagtaaactgatccatatagtgaccgttcaaatcacgggccagttgttccgatgcggcataaatttgtcctgcatgatcgacaaaatggcaacggccaccgtagaaggtgatttgttcaactttacgtcgcgtggtaccacttggcatgacagcgataaatggcaggccgatcaggcgagcaaagtaggcttccgagaccgcagtactccccgatgaagcttcaataatggtcgtcccttcggttatccagccattgcataagccatataaaaacagtgaacgcgccaagcggtgtttcaaactgcctgttgggtgggtactttcatcttttaaatacagataaatacctggaaaagctgataaatttaagcgaattaaatgcgtatcagcggagcgttgaaagtcagcttctatttcattgatagcatttttcacccatgtattggtcatttgatggcctgtgatataggtagttaagtcatggcgactaggttaacggttatcaaagaaaaaagcgttgccatttttccttctttatcgccaaatggtagaaattaattctatggtttaccactatgctagataaaacagatcgtaaactactgcgtatgctgcaggaagactgcacacaatcgctgcacgtgttggccgatgcggtcaatctaacgtcaaccccttgctggaaacgtttaaagcgtttggaggatgaaggttttatccgcgggcgagtggcgttactggatagtgaaaaattggggctggggctgacggcatttgtgctgatcaaaacacagcagcataacagtgactggtaccaagagtttgtcgcatttactaagcaaatgcctgaggtactggctttctatcgtatggccggagaatacgactatctcatgcaagtagaagtggcagatatgaaaagttatgaccgtttttataaacggatggttaacggcgttccggggcttattgatgtcacgtcaagttttgcgatggaaaagattaaatacaccaccgtgctgccagtcccggagtgaataattcactaaaaaatctgtttatcaatggtatcctagagcatcgtctatcgcgaaaaacacaccgacactttcggtatcagaccatggaataaaactgcgtgagattgtttgcacaattaggttggtattttcgccgtgaatggcaccgttatgtaggggcggtgctactactgattattatcgctattctgcaattaattccgcccaagttggtgggcgttatagtggatggtatcagtacaaaacagatgtccaccaatatgttattggtttggattggcgtgatgctcgcgactgccgtggtggtctatttgttgcgttatgtctggcgagtcttattattcggtgcctcttatcagttggcggtggagttgagatctgatttttatcgtcagctgagtcggcaaactcccggtttttattcacgtcatcgcactggcgatttaatggctcgcgccaccaatgatgttgatcgcgttgtcttcgccgcaggtgaaggggtactaacgctggttgattcactggtcatggggtgtgcggtattgattgttatgagcacccaaatcagctggcaattaacactgttatcgctattaccgatgcccatcatggcgatagtgattaagtattacggtgaccaacttcatcagcgttttaaatccgctcagggtgccttttctttgcttaataatcaggctcaagagagcctgaccagtattcgcatgattaaggcctttggtctggaagatcgtcagtcacaacagtttgctcaggtagcggcagaaaccggtgcgaagaatatgtatgtcgcccgcattgatgcccgctttgaccctacaatttatattgctattggtatcgctaatttattagctattggtggcggtagctggatggtggtgaataacagcattaccttagggcaattaaccagttttgttatgtatttggggctgatgatttggccaatgctggcattggcatggatgtttaatattgttgagcgcggtagtgccgcttatagccgcatccgcagtttgttggatgaagcacctgtggttaaagatggccacattactttgtctgatgtgcgtgacacattagcggttaatattcgtcatttttgttatccaggcagtgatcaaccggcactacataatgtggtactgacgctggttccaggggccatgctggggttatgtgggccaacaggttcgggtaagagtaccttgctggccttaatccagcggcaatttgatattgatgacggtgttatttgttatcaagggcatccgctgtcggatattcggttgaatgattggcgtggccgtttatcggtcgttagccagacccctttcctgttctccgatacggtggccggtaatattgccttgggtaaacccgatgcgacccccgcacagattgagcaggtggcccgcctggcctgtgtacatgaagatattttgcgtctgccgcagggttatgacactgaagtgggcgagcgtggagtgatgttgtccggtggtcagaaacagcgcatatctattgccagagcgcttttgttggatgctgaaatacttattcttgatgatgcactttctgcggttgatggtcagacggagcatgaaattttaaaaaacctgcgcgagtggggcgaacaacgtaccgtcattatcagcgcgcatcgcctttctgcattgaccgaagccagcgaaattctggtgatgcaacatggcggtgtaatgcagcgggggccccacagccttttagtcaatcagacgggttggtatcgggagatgtatcgctatcagcaattagaagccgcattggatgacggtgagcaggaggtcgaagccgatgaataacgctcagcaactttggccgacattgaaacgcctgctttcctacggttcgccttatcgtaaaccgctggggctggcagtcttaatgctgtgggttgcggcagcagcagaggtaagtggtccactactgatcagttattttattgaccatgtagtcgccaaaggcacattacctctggggctagtcagtgggttggcattggcctatctgttgttgcaattattggccgcgacattgcactattttcaggcattgctgtttaaccgtgcggcagtgggggtcgttcagcggctacgcattgatgtgatggacgctgcattacgccaacctctcagtgcttttgatactcagcctgttgggcagttgatttcccgagtaaccaatgacactgaagtgatcaaagatttatatgtcatggtggtttctacggttttgaaaagtgcggccttaattagtgcgatgctggtggcgatgtttagtctggattggcggatggcgctgatttcaatttgtatcttccctgcggtgttggtggtgatgacaatctatcagcgctatagcacccctatcgttcgccgggtacgatcctatctggctgatattaacgatggttttaatgaagtcattaatggcatgggcgtcattcagcaattccgtcagcaggcccgtttcggggaacgcatggcgtctgccagccgtgcgcattatgttgcccggatgcaaaccttacggctggagggctttctattacgccctttattgagcctattctccgccttggtgttatgtggtttactgctgcttttcggtttcagccctgaaggttctgtgggggtgggtgtgctgtatgcgttcattaattaccttggccgcctgaatgagccgttgattgaactgacatcgcagcaatcaattatgcaacaggccgtggtggcaggagagcgtatttttgatctgatggatcgtgcgcagcaggactatggtagcgacaatattcccttgagcagtggccgtattcaggtggaaaacgtcagctttgcgtatcgctcggataaaatggtgttacacaatatttctctcagtgtcccctcccgtggatttgtggctttagttgggcacaccggcagtggtaaaagtacgctagctaacctgttgatgggctactatcccattcagcaaggtgagattttgcttgatggccggccattatcccgcctctcccatcaggttctgcgccagggggtagcgttggtacagcaagatcccgtggtgttggctgactccttctttgcgaatatcacccttgggcgtgaccttagtgaacagcaagtgtgggaggcactcgaaaccgttcaattggcacagttggttcgtaccttacctgatggcttgtacagtttacttggggaacagggcaataccttgtctgttgggcaaaaacagttgctggcgatggcgcgggtgttggtgcaagcgccccaaatcctgattctggatgaagccactgcgaatattgactctggcactgaacaggctattcagcgggcattacaggtgattcgaaaaaataccacgctggtggttattgctcatcgcctttcgacgattgtggaggcggatagtattttggtactgcaccgtggtgttgcggttgagcagggtaatcatcaagcgctgctagctgcccgtgggcgttattaccagatgtaccagttgcagttagtcagcgaagatttggctgccattgatcaggaagctattgataaaggctctattgatcaaagcactattgatcaagccggaatgagcgtgagttaagcagcacgcgtggggtgatgtcgccccacgttatttattgactcactcactcactcactcacttacttattctcgtcctccgctctcaaggagtagactgccctttgaatgcccatatttaccgctacatcgcactatcatcttgcaaacccattcatcttgcaaacccatccatcttgcatccccatcgatcttgcatacccactcatcttgcatactcatcgcctgttaaccgcaacatgcactttcgcaaggctcattgcaccaaatcggtgcgctaaagccattcaatcgcggtagctgcattgagcctctctggttttacttatcctaatctccctagacacgctattttcacactaaattatcgccgtgattacttatggcatagcctttgctttatctgtttcgtggcagacgtgaattcgacttaattcgagaaggggcaaatatgaagctggttaccgtggtgataaaaccatttaagctggaagatgtgcgagaagccttatcttctgtaggtattcaggggctgaccgtaaccgaagtcaaagggtttggtcgccagaaagggcatgcagagctttatcgaggagctgaatacagcgtcaatttcttacccaaagtaaaaattgatatcgccatcgccgatgatcaattagacgaagtgattgatgtgatcagtaaagcggcctataccggaaaaattggtgatggcaaaattttcgttgctgaattgcaacgtgttattcgcatccgtactggcgaaacagacgaagcagcgctgtaatttgcaggctcaaatttagagaatagggatgggttgatgatgaaaaaacttttatccgtgttgggcctgggtacggtagcgctgttaccttcttgggcaatggcggcggcaccggcagtcgctgacaaagcagataatgcttttatgatgatttgcactgcgttagtactgtttatgacgatacccggtattgccctgttctacggtggcctgttgcgctccaaaaacgtattgtcaatgatgactcaggtcatggtgagttttgcgctggtatgtgttttgtggattctctacggctacagcctggcgtttagtgcgggtaatgcgttcttcggcagttttgatatggccatgctgaaaggtattgagctgactagcctgagtggctcgttttatcaatatattcatgtcgtgttccaagcctcatttgcctgtatcaccgtcgctctgattgtgggttcattcgcagagcgtattcgtttctcagcagtattaattttcgccgcgctgtggttcaccttctcttacctaccaatagcgcacatggtatggggtggtggtttcctggcaatggacggagcgctggattttgctggaggtacagtggtgcacattaacgccgctgttgctggtttggtcggggcttatctgttgggtaaacgtgccggattcggtaaagaggccttcaaaccccataacttaccgatggtctttaccggtacggcgattctgtatattggctggtttggcttcaatgccggttcagccagtgctgcgaacgaaattgcagcgctagcgttcttgaataccgtcgttgcaacggcgggcgccatcctctcgtgggtatttgctgagtgggctttacgaggtaaaccttcgctgttgggggcatgttccggttgtatcgcaggcttggttgcgattactccggcagcaggtacggtaggggttggcggtgcattgattatcggtttggttggtggtgttgctggcctgtggggggtcgtgctactgaaaaaatggctgcgggtcgatgatacctgtgatgtcttcggtgttcatggtgtgtgtggcatcgtcggttgtattctgacgggtgtcttcacctcggcgtcgctgggcggcactggttatgctgctggcgtaaccatggggcatcaggtcggcgttcagttattcagtgttggtgtgactgttgtctggtcgggtgttgttgccttcgttgcctttaaaattgcgggcttgattgtgggcctacgggtacccgaagagcaagagcgtgaaggtctggatgttaacagtcacggtgaaaacgcatataatcaataagttaattttccgtcaatcgttagttgttagcctgtcggaagagatagagcagtaagttaaaaagaaaaagacataaagaaaagaggggcagttgttggagaatagtggggcagtcgttaactgccgtttcagtaaaaccagcagcacataaaaatacataataatgatgaactacaggggcgatggtgacatcgcccctgtgctatttcattgattcatcaactggttgagataacgtcacgctgatctgtaccccccgtatcaacgatgtaaacgaattacaccctcctgcacagtagaagctaccagcaccccttcccggttatagatttgccctcgaacgaagccacgggcacctgacgcagaagtactttctacggcatagagtaaccagtcatccaaacggaatggccgatggaaccacatcgagtggtcgatagtggcgatttgcataccgggttcaaggaaaccaatgccgtgcggttgtaaagccgtgggcaggaaattaaagtccgaggcataacccagtaaatattgatgaacccgtaggtcatctggcattttgccattagcgcggaaccaaacatagcgattgggttcttctacactgccttgcagcgggttgtggaattttaccggacgcatttcaatgggttgtgggccaataaacttttctcgcactttctcggggatcaagtgtgaaaactggcgggcaatatccgtttcggacattaacccttctggtggtgggacgtctggcattgtattttggtgctcaaacccttcttcctgactctggaacgaggccgtcatataaaagataggcttaccattttgaatcgcactgacccggcgggcgctgaaactgttgccatcacgcagtgtttctacgtcataaataatgggtttactgctgtctccagggcgcagaaaatagctatgaaatgagtgaacagtccgttctgcggggacggtttgtttcgcagcataaatcgcctgaccaacaacctgaccaccaaatacctgccgcaaacctagatcttcgctttgtccacggaaaatgccttcttcaattttctctagatcgagcagatcgagcagtttttctaatgcctgactcatgttgtcgcccctgatggttgagttcatacacagtgtgctgaatcaacccgccagtcgtcaatatattgccgtgaaaccattactcaagtgatgaattaatcgtgggaagtgatctgctgaatacatcaaattggggcgattcggtaataattcgagctttatgctataattagcacgctaggtggttgaagccacttattaacgcaggcttttctgtgaatagccagcatcttaataataacaaggagggaggcctatgaaaccttggcagccaaaggcattatggcaaatagtgggtggcgcggcattagcagtaagcctgacagggtgtgctcatcaaagcgcggaggctcccgttgcagcacctataagtacagcgacggttgcggcatcggtcgcacaatcaacggtccatgggactgtgaatattcgtgaacgcgttgcattaccgcctgatgcggtggtaaccgtcacgctgtcggatatctcactggctgatgctccatcgcgagttatcgcgcagaaggcggtacgtactgaaggtaaacaagcaccgtttacttactctttaccgtttaatccgtcggatatccagccaaatgcacgcgtcattgtcagtgccgcgatcacccgcaatgggcaattactgtttatcactgataccatccaggaagtcataaaccgtggcgcgggtactcaggccgatctattgctggtccctgtaccttcggtggcgcttgaaatcgctccagcgcctgccgctgccacgatacagtaaacagccttatacccttcttatttgacgttgccgcggatcccgctctaataactggcgtgggtcagttcattggagcccgcgggttgtgctgtatgcaacgccaattacgttgggtatatcagctatcacatcgcactagctgtatcgccagcgatattgctgcaaattaattcggccagcagcatcaagacaaataccttccgccacgagcgcctttttttgcctgagataatcatcgcctgttaatgatatctcaccatatcgattaattacccggtgccaaggtagtgcagacccttctggtaagcgctttagcaccccgccaacttgcctggccgctcttggagaaccaattaactgcgctatatcgccataggtcgctacctgcccataggggatagccgcaaccacatggaatacccgctgacgaaagctatcggctaccggcggtgtattttgctctgcggtataatcgggctcttggtattcatcctgatctgaatgacggctttctggaggtgacacagcattctctcttttaaccgatgacttgcgtggcctgttgtcgctcaccgcaatgttgttgtttaccgcaatgttgtcgctcaccgcaatatggataccctgcactatgggggattttatgccagtggaaaatagatttagcttgatgtgagcatttactgggcaagaaaccatcggttagcgcgtgttgtcttgctattttgcagggcatggtcaataatgcccaccgctccagaatgcaggggccgttaatatcaatggaggccctgttggttctcccgcaacactaacttgtgaactcggtcaggtccggaaggaagcagccgcagcaggcgaggtgtgtgccgggatgtagctggcagggcctccaccaattcagttttatcgtatttccactttatcgctatgtcctgtattatcactttcctgcgtcctcactatttctctctgtcatcactgctctgagtacaatctctgaggctttttgtcgtgaacgctctctatcagtagatttttatttccggcatgattgagcaaagaaattgtcgttagggaaaataagattcctcccattctgaacgaatggtttgatttttatttatgtattaggtttgtaaaatatggctaattaataatatcttgtaattattagactagagggctgaatttgaatgagcaaacaaatgaatgcatttgttacttaaatgatcttacattagtttgataacactcaattttcacctaagaataggtaggcagaaatacgggattgaacgccaatctccaatactgccactaggccaataattttattaagaattaaaacacgtgctaatcatcaaacccattgaagccgatagagattatcggctcaacgttgtgtgtcttaaccagcgctaagcagactatttcacatgttgccatacagtaggtggaattttatcataaagcttattcatcgttagttcagccaggcgatggtctgcagctgagtaaaacaattccagttcatcatcagaaagttcgtacttatttttttcaattacacgttctagcgtatcgatagtcgtacattttcttaaacgcatcaggtagtcagtttttgtcatggtggtttttcttctcgatatacaaattaatattggtggaactatcccttaagttttcatcagggtacatacgtattcccctgagaaaagtctgaataaatgctctttggttttctgccagcgacgcaattcaggatcattgattccataactactaaacagagtatatgtgtcgtctaaatattcttccactaactcggaaagctggcttccatccgggtattttattttaaaactcatcacaaatgaagctatatgctcgatcaaatcattgagttgaaggtttatggccgacgttgggtcatttatccagccatgatggctgtcgccaagagttgcaataccttcatcatacaagctttcacatagaaacttcagttgggcaatgtcatgccgcttaggcgagtactcatccatatcatcccctccgtaatgtcttaattcggtgttgataacacaatgtgagtagattcgtagtcatataaatacagctgtctatcgttaaagtaaataaacttgctatgttatgaatataaatcatttcttcgcttatcgcgcaactttattacggaatcttacaattcatccgcaggagaaggcctgtcattactaattatatcaaaaacgattttttcaggatgtacaataaatgttacagtgtttgttagaaattcttcagtattgatatccaaacaagcattgaaaatataccaattatattggtaagtcattgaatactggttctctttgagatttttaatctcaagaatttctaatgatccaagtgtgtaccgagcatcttctgaataatacattaacccagaaaccaaactttcctcaattgagtggatattattacggataacgtctttcagtaatgaaactgagtaatgccctgaaacgaagtcaccaactatttcattgttcattaatcatccagtcatcggggtaaaaatacgtcacaacgacattataattgttgtgaaaaatgcttggatattagcatttcagcaatcactcacatgacttaaatcaaatttaatgatgtttttcaatgtgaatttttgagcaactcatcacggtgttatttgaacatcatgttttgcgataaaataacatctgcaaaataatttttcacatatttaaaagggagagtcaccgcttaatttaattctccctactattaacctgacccgctctgttggtttggtcacatctgttggtttgaccatgaatgttaatagccatattgtttggctgtttattgtacggtgtattcttccacaaaccaagaggattaaacttggtggcagggcaacaaagtcataatcggtctcgcgagtataatataaggtctattttctgtcacctatgaggttatcaacggaagtttaagtcaataatgtgggggggggaacacacggattagccagagaaaataagggcttattttattgaaaacccgatgaatacacgttttctcaaaccaatagccgtggccagtagcgctttactatgtagtgacctagtaggtaaccaatagcgaagcatttaaacgtattgtagggcgttgtaagtaaccgtattaggatctaatccgcttacatacttgtggcgcctaaactccgtctaagtcgacaggcgctatctctgatagcaaatgaataaaaaggcccgttggcgttagtgcacaaagggccttttggggactgatgaatggttatttgactgatggttatttggttgaccgagagttattacaacactctgatagcgtataacaaacttaacatcagcgttttttatgggttcctccctgaaccgctttaaagcgagggttgcttttgcaaattacgtacactcggccacggcgacggacaatcttgcagtctggatggcggttctttgccgaacgtaatgaacttaatacttgcatggttaactctccgaattagttggttttcttcgttaagaaactaccgaaacgttggtggaagcgtgcggtactgccttctttagcaaactctttttgcttaccggtgtagtacggatgcgaggctgaagagatatctaatgtgacgtaggggtacgtctggccatcgcgttcgattgttcgctcagtggcaatggttgaacctacagtaaaataagcatccgcactggtatcgtgaaataccacagtccgatacggagggtggatattgggcttcataatgattccttttggtatgttataatataacatcattatgcgttttactgtttccagtttcaagcccgaaatgactcttcattgctattttttgtagagtgaggggaggggaaaaggataacgctcagcaataaaaaggccgcttgcgcggcctttagtatgaaatgacaagttgttaacgcagtttatttcaccggcgtgttaactggatgactatgttcaatatcatcagtctttctactgaagcggcgacgaaccacaacgaagaatagcggaacaaagaagatagccagtacggtcgcagtgatcatcccccccattacgccggtacctaccgcgttctgtgcaccagaaccggcaccactactgataaccagtggcattaccccaaggataaaggccagtgaggtcatcaatattgggcgcagacgcatacgcaccgattccaatgttgattccaccaagcccttgccttctttatccatcaagtctttggcaaactcaacaatcaagatggcgttcttggccgatagcccaatggtggtcagcaagcctacctggaagtaaacgtcgttttccaacccgcgcagtgtggctgccagtaatgcaccaacaaccccgagcggtaccacgagcataacggagaatggaattgaccaactttcatacagagcggccaagcacaagaagaccacaatcaatgaaatggcatacagtgctggggcctgattacccgatagacgttcctgataggacattccggtccagtcatagcctacgccacttggtaatttagctgccagctcttgcatcagatccatggcttcgccggtactcttacccggtgcagcctgacccagaatctccattgatggcaacccattataacgctcgagccgtggtgagccatattcccatttcgcggtggagaaggtcgcaaatgacaccatctgacccatattattacggacataccacttatcgatatcatccggcaacatacggaatggtgcatcggcttgtacataaactttcttcacacgacctcggtcgataaagtcgtttacatagctgccgcccatggctgaacccagcgtggtattgatgtcagaaatagcaacgcccaaggcttgagctttctcctgatcaacttccactttaaactgtggtgtatcttccagcccattagggcgcacgccaaccagcatatctggatgttgcgctgccatacccaacagttggttacgtgcatccgttaattgttggtgccccaggttaccctgatcaattaactggaagtcgaaaccggtagccgtacctaactccacaatggcgggtaagttaaaggcgaacaccataccgtctttaattttcgagaatgcagcagaggcgcggctgacaatagctggaactttattttgttcgcctttacgctcatcccaattcttcagactcacgaatgccaaaccggtgttctgaccttgaccactgaaaccaaagccgttaacggtgaacacggagttaaccacatctttttctttgtcgagatagtaatccgtcacctggttcagtactttctgggtacgttcttgcgtagcacccgcaggcaattgcaccatggttaggaacaccccctgatcttcttctggcaggaatgaagacggtagacgcatgaaaagcaccgccataccaatcacaatagccagatagataaccagataacggcctgtgctgcgcaaaatattggcgacactgtcggtatagtggtgtgtactcttttcgaacatgttgttaaaccagccgaagaagccagtttttggaccatgatcgcctttcttgatcggttttagcatggtcgcacacagtgctggtgtcagaattaatgccaccagaaccgaaagcaccatggccgaaacgatagtaatggagaactgacggtaaatagccccagttgcgccaccgaagaaagccatcggaacaaataccgcagacaataccaacgcgatcccaaccaatgccccctggatctgctccatggattttttggttgcttctttcggtggtaagccctcctcttgcatcacgcgttcgacgttttccaccaccacaatggcgtcatcgaccaatagccctatcgccagcaccatcccgaacatcgttaaggtgtttatcgaatagccaaaggcggacaaaatagcaaaggtacccaatagcactaccggcaccgcaatcgttgggatcaaggttgcgcggaagttctgtaggaacaggtacattaccaagaacaccaagataatggcttcgatcagtgtcttaaccacttcgttaatcgaaattttaacaaatggtgtggtgtcatacggataaactacggtcaaccccgatgggaagaatggctgtaatttggccaactcggctttcactgccgcagaggtgttcaaggcgttcgccccggtggccagcttaataccaatacctgcggccggtttaccgttataacgggcaatgatgttatagctttcagcacccagtttaacgatagccacatctttcaagcgaacttgcgacccgtcggtattcactttcagtaatatctggctgaactcttctgcattggtcaaacgggtttgtgcaatgattgatgagttcaattcctgacctggtactggtggtgtcccccccaattgacccgcagcgacctggttgttctgtatttttatcgcgttaatcacatcgaccggtgtcagcttgtagttattcagcttatgcgggtccatccagatgcgcatggcatattgggaaccgaacaactgaacatcacctacccctggtgtacggctgatggggtctttaatgttagagcccacatagtcggcgatatcttcctgctgcatcgtaccgtcttcagaaataaaaccggcaaccatcaggaagctactactggacttttcaacgctcacgccctgttgctgcacttcttgtggcagcagtggcatggctaattgcagtttattctggacctgaacctgagcaatatccgggtcagtgccagagttaaaggtcaacgtcaactgaacgttaccggaggagtcactgctggaagacatatagagcaggttatcgatgccgttcatgttctgttcgataacctgcgtcactgtattctgcacagttgtcgcatcggcgccaggatagttggcggcaattgtaattgccggtggcgcaatggtcggatattgcgctactggtaatttcatgatcgcaagggcaccagccaacatgatgatgatggcgatgacccaagcgaaaatagggcgatctataaagaacttagccatgaattaccggctccttttaagacttcttcgctgtatcagccggggctgtttctggtgcagtgtcagtaacttcctgcacttttacctctacacctggtttgattttctgcaagccggaaataatcaggcgatcaccggcttttagcccttcagtgaccagccatttattaccgattgcttggttcgctatcagggtacgcatttcaactttattacccgcgccgacgaccatggctgttgcttcaccacgtgggttgcgagtcacgccttgttgcggaactaacagcgcatcaggacggataccttcatccaaacgggcacggacaaacatgcctggcaacagcgcctcatttggattagggaagatcgcacggagagtaatcgaaccggtagtttcatcaacagtgacaccggagaactccaaagtaccggtttctgtatattcaaccccgttttccagcaacaaacggactttagctttgccgttttcttgcttgagaatgccatcagccagctcttttttcagccgtaggaactcatcactcgattgagtgacatcgacatacattggatcaagctgttgaacggtagtcattgctgacgcctgaccactggtaaccaatgcaccttccgtcacggcagatttaccggtacggccgctgattggtgatctcacttgggtatacgccagattaatgcgtgcagactccagtgccgcttttgctgctaacacggtggcatctgcttgttgggcatctgatagggcctgatcatattcttgtttactgatgtagttagtacccaacaatggcttgtagcgattgacggttaaatgagcaatttgtgctgaagcctgtgctttagccagatcaccttttgcactgtcataagcggcctgataagtcgcagggtcaatttgataaagggatgttccggcggtgacatcactgccttcaatataattacgtttgagaataatcccgcttacctgcgggcgaacttctgcaacacggaaggcggacgtgcggcctggcaaatcggttgtgatattcagcggttctgctttcaatgtcacaacaccaacctcaggagcttgttgagcaccggcttgcgccgcatctttgtcattacatcctataagtactaagctgcctgaaagtaccagaattgcagccagaggcattacccctctgtttttgctcatagataaacctcaagtgtccgatttttaatttaattcaatggatcacaagctttaaaacccattgctgcgtaaatgatatgtgcgtgctatggtacatacattcgtgaatgtatgtaaatctcaccccccgaaaaaacaacgctatggcacgaaaaaccaaacagaaagccgaagagacccggcaacaaattctagatgccgcagtgcgggagttttctgcgcatggcgtttccaggacttctcttaccgatattgctatcgctgcgggtgtaacccgaggcgctatttactggcacttcaagaataaggtagacctatttaacgaagtttgggagctatccgagtctaaaattgatcagctcgagatagagtatcaggcaaaatatcctgataatccactacgtatcctccgcgaactcctaatctatattttggtttctactcgtgaggaccgccgacgtcgtgcactgatggaaattgttttccataaatgtgaattcgtcggtgaaatgacctccgttcatgacgcacgtaaagtccttgatttagctagctatgagcgaattgagtcggttttacaaggttgcatcgatgctaatcaattaccggtcaatctcaatactcatcgtgcggcaattattatgagagcctatattacaggtttgatggagaattggctttttatgccagaaagctttgatataaaacaagaggcacctgtattaattgatgcctatctggagatgctaggccagagtttttcattacgaaacgagatgaatagcagagtatcggattaactggaggtttatatgcattcgctggtcattattgctaatggtgccgcttatggccatgagtcattatttaatgccttacgcctatcgattgcgttgaaagagcaacaaactgatttggatctacgcctgttcctaatgtctgatgcggtaatcgccggtctcaacggccagcaacctcgtgaagggtataatttgcaacagatgctggaaatcctcaccgcacaaaatgtccccataaaactctgtaaaacttgcgcagatgcgcgtggtattgcgggtctgacacttgttgatggggtggagattgggacgctagtggagttagctcaatggactctggccgcggaaaaagtcctgacgttctgacataatatgcagggtgttttttctgctacaatcatttgatattttcagttattacatcctatgcaacgcaggctgcgtagctgctcgcattattacaggtatccatgctctgaaaggttttttcttatcatggcttgagacttaacgtgataggatttcagcctctctattgagatgaagttcaaatatgagtagcagatttaacacacggctttcttcaccctctttatcgttattcgtgtcatcaagagcacgaattgcgttattcgatccatttctattctgtcgccagacgatgtttactctggttattattgttttattgttattttcttcgacctttgtgtttggaatatcggcctttgcgtctggaataaatgttgatgtgcctactcgcagcgaggtacagagccagctcgatttgttatcaaaacaaaaaatattatcgccggcggaaaagttagcacagcaggatttgactcaaacgttagagtaccttgataccattgagcgcactaaacaagaggctaatcaacttaaacaacaactggcacaagctcctgcaaagttacgccaggcaaccgaagggttagaggcgctaaaaagcagttcagctgataccatgaccaaggagtcattggctaattattcgttgcgccaattggaatcacgtcttaatgaaacgctggataatttacaatcggctcaggaagatctctccgcttataacagtcagctaatcgccctgcaaacacagccagaacgtgtgcaaagcgcgatgtatagcgcttctatgcgtttaatgcagatccgtaaccaactcaatgggctgacgccgaatcaagagagccttcgcccgactcaacagcaagaacttctggctgaacaagtgatgttgaacggccagttggatctagagcgtaaaaatctggaggcaaataccaccttacaagatttgctgcaaaaacaacgggattacacgactgcaaacattaatcaactggagcgttatgttcagttgctacaggaggttgtcagcggtaaaaggctgattctctccgagaaaacagttaaagaagcgcaagcacagactgatggcagtgatatccaaaatgatccactcatcagccgtgaattggcaattaacaaagagttaagcgaacggctgattaatgccacgaaagaaggcaatacgctggttcagcagaatatccgggtaaaaaactggttagatcgcgctctgcaatctgagcgtaatttaaaagaacaaatcaccgtattgcgtggcagcttattactttcacgaattctctatcaacagcagctcaacttaccggcttccggccttatcaccaatatggggccacgcattgcagacttgcggctggagcaatttgaaattaaccagcagcgcgataagttattccaaggggacgactatatccaaaccctgatggagagcagtaaagagaaggttgacccaaatgtagaagatgcgctggggcagattgttgatatccgccgtgaactactggatcaattaaataagcaactgggtaaccaattgacactggcaatcaatttacagattaaccagcagcagttgctcagtgtcaatgagtcgctgcaacatacattaacgcagcaaatattttgggttagtagtaataagccaatggattggtcttggctgaaagccctgccaggggcgatcaaaaccgaactgagtaacttccaggttaccctgtcattgggggatgcgctggcaggcctgctcaaatcactggtttttctaataccaatgctggttgtggctgtggtgatccgctcccgttaccacatgatcaatacctatttggatcaactggctgctgatatcgggcaattgaaacgcgatagccaaatgaatacgccaaaggctattttgttgactgtgctgaaaatcttaccgaacgtattacttatcttggggatcggctactggtgtttgcgctcagatttcaacctcagtggcttgctctggagcttcttccagcgcctggcattgttctggctggtctttgagctgacctatcgcatgttatcgccggggggaattaccgagcggcactttatgatatcaaccgaccgttgcgcccattatcgccgccagatagtccgcttaggtgccgcgttgctgccggttattttctggtctgttctgggtgaacgaagccctctacggcttgtggatgatgttattgggcagatagtgattgttattgccttggcattattagcactgtttattttcccattctgccgtgatagctggcgtgagaaagactcccatgcggtacgcttagtcattatcactgcaatcactgcgacacctatagtattgatggggttaatggttgcggggtatttctatacaacattgcaattagctggccgttggattgatagcctgtatttactcttcttgtggaacattgtttatctgacggcgatccgtggattaggtgttgctgcacggcgcttggcataccgtcgagctattgcgcggcggcaaagtatggggaaagaaggggccgaaggcagtgaaccgatagaagaacctccattggctctggatcaaattaaccaacaatcattgcgcttgaccacaatggcgctattcctaatttttgctacctgtttttactggatctgggctgatctgataacggttatctcttatctggacagtatctcattgtggcattacaccgccactgtagctggtgcgagtgtaacgcaagcggtgaccttgggtaatatgctagtcgccttgatggcactggtggtcgcctatgttctgacccgaaatttaccgggcttacttgaagtggtggtgctatcgcgcttacaactgcgccaaggcacttcttacgccattacgacgattttgacttacctgatcacggctgtgggggggataaccgccttaagttcgctcggggtttcatgggataaattgcaatggctggtggcagcgctctccgtggggctgggctttggtctacaggaaatatttgccaactttgtctcgggcttgattattctctttgagcggcctgtacggattggcgataccattacgattggtacctactcggggactgtcagcaaaattcgtatccgtgccaccaccattaccgattttgatcgtaaagaagtcattgtgccgaataaagcatttgtgactgagcgcctgattaactggtcactatcagacacgatcacccgcatcattattaaagtgggggtcgcgtatggttcggatttggaaaaagtaaaagaagttctgctacaggcggctcatgccaattctcgggtaatgacagatccagagcctcaggtattcttccttaactttggttccagcacacttgatcacgagctacgcttgtatgtccgtgaattacgtgaccgcagttatacggtcgatgagctgaatcgggctattgataaattatgccgtgaaaatgacattaatatcgcgtttaaccagttagacgtgtatttgcataaaccggatggtaccgaagttcaggaaatcagccgcccgattgaagctacaagcttgcctgctacgcaatcaatgctgggaaagccaaaacctgatttaccctgatttgcctgggtttttcggatatcagggcaccaacaattagccattatggctgacgtgagtgagctactgttgttaaaaagctacttttgttaaaaggctaatgttgctaaaaagctaatattgttaaagagttaatgttgttagaaaaccactattattagagaacaactattattagagaaccactattattagagaaccactcttgttagcgaacaacggttgttagagaaccagtgctgcgaaagggccggtgtcgtggtaatgctaatgtcgtgagataacccatgtcattgcaccagcagcataaaagcgggaatagcagaggcgatgtcgtgccgagtcgcctcagtacacatcagaagtagtaggttcagtctgattctttatggcgaagtttacgttggtaatcaagttgtacgatagccaatgctgcgagagccgtttccggtgctatttcgttacattccagcagatagataagatctactgccagttgtagttcaggtggtgcttgttcaactgacatatatgtgaccaatatttaaagtttcaattaacgaaagaagcggagcagagcagtcactcaccagtgctagcttcgctaggtttccatttagaaagtattttagttcagaaaatattatagataataaatcgtgaccagcgtttcagtgattcaaaaaatgtgacaaatattcaaaaaccgttctcttttttctcaatactgcgctctattcttatcagtgcctggcggcaacgcattaaacggccttccagagcggctaactctttttgtattttctgctgttcaactaacaaactctgctgacccagttggctttctcggtcttggatcatcgccaggatccgccgttcataatcttgatgctcagccagtttgtgataagggtctgattgatgatcacgtggttcaggattggattttcgtattttctgtgttgctagttctctctgtagggctgaaatttgtgcaactaacttatctgccagaaatgccacttgctgtaagcgattttcctcaacaacttgttttagctgtgtcatatttttgcgcacttcttgcaagtaatcgcgaaagcgattgccgtggttactgaataaattcagatcaaaacgtgcttgctgagaaggcgtattggcttgcggggctatttgagctgacaatgcttcaatctggctctctagcacctgtaataatttttctgtactcatagcgctctcctaggcattttgtcgttagcttgccttcgaatagtggtggttacaagtgagaatgcgcctgccaatgagcgcggtagataggtatagtgctaatagtgacaacaataagtgacaacaatatttgttgatggtcggcactacatgcgttaatgataacgctttcttgacgaaagtaacgataaagggagcttatgtctcgctggttattaatagctctggggtggttggcagtggtattgggaacactcggtgttgtgcttcctcttttacccacaacaccatttttacttttggcagcgtggtgctttgctcgctcctctccccgttttcatcattggttgctttaccgctcatggtttggcagttatctgcgcacatggcagcaacatcgtgctttacctccgggcactaaatggaaagcagttttggtgacggtaatgacttttgctgtttcactctggctggtgaaaatttggtgggtaaagggaatgctacttttgatgttaatcgtattattaacttttatgttgcggatgccagttattgacccatcgcaacaaaaacggcactgaacactgcacatcagttgctttttggtgctggtttgcataaatttgagtgtttcgtgcgcgggggttatcccttgttacgtccttaaggctaaggatgtggtgattcggctatcaaggtttttatcgaaatttttgtttttatcgaaacttttcggtggcctatgtcactcagataacgctattttcgcattatctggccgcgctttagtatgtccagcagttttatcaggcacaaattatgaccgtttctgcatctaagacagcacaacagcttaaatatataaaagacagtatcaaaactatccccgattatccaaaagcgggaatattgttccgtgatgtgaccagcttgctggagaatccaaaggcctattccgccagcatcgaactgctgtctgaacactatagtgagtccggtgtgacaaaagtcgtgggtactgaagctcgcggttttttgtttggtgccccggtggcactggcgctgggggtaggttttgttccggtgcgtaaaccgggaaaattgccacgtgaaacgatcagtgaaagctatgaattagaatacggcactgacactttagagatccatacggatagcatccaaccgggtgataaagtcttggttgttgatgatctattggcgactggcggcaccattgaagccacggttaagcttattcgccgcttggggggggaagtggttcacgcggcatttattattaatttacctgaactggggggcgaggctcgcctgactcagcaagggattcattgctacagcctcgtttctttcgacggtcattgattgcattgaaaacaacagcctcgctatctatatagaatcagtccaatagcggggctgttgagtccataattccgatcacccagcctcatcttctggcctgatactttttaactcgccgggtgtcttccgagatagttaaggtattccagccagacaaactctggttttatatcgtcatatccctgcgtctctgccattttttcggctaccatttttcgactatcattttttcgactccatctaaatggaagcctaggcataccccatgaacacggatattttctgcctcactttgcgttaagagtactttttttgatcttgtgcggtgatgagtgatgcgatgagtgggctacaaatatcaatgctaaaatttcttccatgtatttattcgctttcgggatatcggttaattttgaaaccaaaccttacgatgaacggtaggtcagttcgtgttcacaaggtaaatttatgggaatgaaaatgggcgtactgatacactacgacgagcgagtcctatgctgtatagggtgggttcatgctgtgtaggttcatgcggcgtaggtttgcaaataaaccaaatcagatatacttggttaaatcatggttttttcattagtgattaaattatccatcataaatcaacgatgaagtattaatgagctatcaggtccttgcccgtaagtggcgccctcaaacgttcgccgacgtcgttggtcaggaacatgtcctgacagcgctggctaatggcctttcattagggcgaattcatcacgcctatttattttcaggtactcgcggtgtgggtaaaacctcgatagccagattgctggctaaaggcctcaactgcgaaaccggtattactgcgaccccttgcggtacctgcgccaattgccaggagattgagcaggggcgttttgttgatctgatcgagatagacgccgcctcccggactaaggttgaggacacccgagagctgttggataatgtccaatatgcccctgcccgtggtcgcttcaaggtctatttgatcgatgaagtgcatatgctatcgcggcacagtttcaacgcgttgctgaaaacacttgaagagccgcctgcacatgtaaaatttctgttggcgaccactgatccacaaaagttacctgttacgatcctttcccgatgtttgcaattccacctaaaagcattggatgttgagcagatccgtgcacaacttgaaaaagtgttgctggctgaacaaatcacgagtgatgccagagccttgcaattactggcccgagcggctgatggcagcatgcgagatgcgctaagcttaaccgatcaggctgtatcaatggggcaagggcaggtcacgacagtaacagttagccaaatgctgggaacgctggatgacgaacagcctcttgccattattgaggcgttggtcagtgctgatggtgcccgggttatggctcagatagaacaggcggcatcgcggggtgtcgactgggaaaacctgttggtggaaagcttaagcctgctgcacaaaattgcgatggtacagttgttgccttcgatgctggataaccactatgcagctattgaaccccgtttacgggaactggcccgcacattaccgcctgctgatattcagctgtattatcaaaccttgctggtaggccgcaaagaactggcttatgcgccggatcgccgtatgggggttgaaatgaccttattacgcgcgctggcttttcatcctaaagccatcattgcggagccccaaatagcgcatgttgccgcgccatctgcaatagccgataacgctgtgcccacctctcagggggggcaacataggcaggaacccgcatcagtaccgccgagttcccatcaagaggctccgccgttaggtgctgtagcgtccagcgtccaacttccggaatcgacagcgcaattgcttcaggcgcgtacgcagttactgcgacagtcggggacgaccacaacaaaaaagaatgagccggcggcgccaggaaaagcgcggccggcaaactcagcactggagcgtttagcttcggtgactgagcgtagccagcagcgcctggcagccaaaacaacggaagagaagaaaccagcgaaaaaagaagcttatcgctggaccgcgaaaaatcaacctgaggtagcggctgaacctatcgctacgcctaaagcgttgcgttctgcgctagaacatgaaaaaacaccagagctttccgctaaattggctgaggaggcgatcgcccgtgatccttgggctgcagaggtcaataagttacagctccctaaattagtccagcagcttgcactgaatgcatttaaacaagaaatagaaccgggtaatatttgcctgcatctgcgttctgctcaacgtcatttgaattcagcgtcagcacaaaaagcgctgagtgatgcattgagtgaattacacggtaacgcggtgacactgagcgttattgaagatgacaatccggcggaacgtaccccgctggaatggcggcaggccatctatgaagaaaagctggcacaagcacgtcagtcaattattgcggataataatattcagacactgcgtcgattcttcgatgccgagctggatgaagacagtatccgaccaatttaaccgctgcgataagtgcatggtgcactgacgcagccctttgcgatgagagataactatgtttggtaaaggcggtattggcaatttaatgaaacaagcccagcagatgcaggaaaaaatgcagcagatgcaggaagaagtcgccaaattagaagttaccggtgaatctggcgcgggcttggtaaaagtgacaattaatggggcgcataactgccgccgggttgagatcgaccctagcctgttagttgaagatgataaagagatgctggaagacttgattgctgccgcattaaatgacgctgctcgtcgtattgatgaaacgcaaaaagagaaaatggcctctgtatccaatgggatgcaattgccaccaggctttaagatgccgttctgatgcaaaccagtccactcctggagtcattaatggaggcgttgcgttgtttaccgggtgttggcccgaaatcagcgcaacgtatggcatttcagttattacagcgcgatcgtagtggtggaatgcgcctggcgcaggctctgacacgggcaatgtctgaaataggccattgtgcagattgtcgtacatttaccgagcaagagcactgcaccatctgcttgaatccccgccgtcaacaaaatggtcaaatctgtgtggtcgaaagcccggcagatatccatgccattgagcaaactggccagtttggcgggcgttattttgtgctgatggggcatttatcaccgatggatggtattggccctggtgatatagggctagatctactggagaaacggctttctactgaggctatcagtgaggtcattttagccacgaatccaaccgttgaaggggatgcaacagccaactatatcggccagatgtgtggccaatatggcatactggccagccgcatcgcccatggcgttcctgttggtggcgagttagaaatggttgatggcaccacgttatctcactcgttagcagggcgtaatcccatcaagtactgatcgtattcctgaccgtgggcgatgaccttattattgattatcttacggataattttattcagaataataaatcaatcgcccccgattctctgttttttctgctttaccgcttgaaactgccgctattggccccatttgatcttcattgttcgattttatctgcctgttggtaatttggattgaggtaattaatgaatatgaaaggtcaagaaacccgtggattccagtctgaagtaaaacagctcctccatttgatgattcactcgctttattccaataaagaaatttttctgcgcgagctgatctccaatgcttctgatgctgcagataaactccgtttccgtgccctgtctaaccccgaactctttgaaggggatggcgaactgagagtgcgtttatcttttgataaagagaaacgtactttaaccctgagtgataacggcatcggtatgacccgtgacgaagtcattgataatcttggtactatcgccaagtcagggactaaagcatttcttgaatcaatcggttctgatcaggccaaagacagccaattaatcggtcaatttggtgtgggtttctactcagcatttattgttgccgataaagttaccgtacgtacccgagctgccggtgcccctgccgataccggtgtattctgggaatctgctggtgaaggtgattacaccatcgccgatataactaaagacgagcgtggtactgaaattacgctacatttgcgtgaaggcgaagacgagtatctggatgactggcgtctacgttctgttatcagcaaatactcagatcatattgcactgccggttgaaattcaggttaaaaatgaagaagacggcactgtcacctgggaaaaaatcaacaaagctcaggcgctgtggacccgtggtaaagcagaaatctctgacgacgaatacaaagcattttacaaacatattgcccatgattttaccgacccactcagttggagtcacaaccgcgttgaagggaagcaggaatacaccagcttgctgtatatccccgcgcaggcaccatgggatatgtggaaccgtgatcacaaacatggtttaaaactttatgtgcagcgtgtgtttatcatggatgaagctgagcagtttatgccgaactatctgcggtttgtccgtggtttgatagattcgaacgatctgccgctgaacgtctcccgtgagattttacaagacagtcgtattacacagaatctgcgcagtgcattgactaagcgtgtgctgcaaatgctggaaaaactggctaaagatgatgctgagaaatatcagcaattctggcaacaattcggcatggcattaaaagaaggcccagcggaagatggtagcaataaagagactatcgctaagctattgcgctttgcttcaacgcataccgacagttccgcacagaccgtgtcactggaagactatgtcagccgtatggcagaagggcaggagaaaatttattacatcactgctgacagctatgctgctgcgaagagtagcccgcatctggaactgttccgtaaaaaaggtatcgaggtcctattgttatccgatcgtatcgacgaatggatgatgagctacctgactgagttcgaaggtaaagcgttccaatcggtcagtaaagcagatgactcactgaataaattggctgatgaagaaaatccagagcagcaagaagcagagaaagcactggaacccttcgttgaacgcgtgaaaacgttattgggtgagcgtgttaaagacgtgcgcttgacacatcgcctaacggatacaccggcaatcgtaacgactgatgcggatgaaatgagtacgcagatggctaagctattcgcggccgcgggtcaacaggctccggaagtgaagtacatctttgaactgaacccagatcatggcttggttaagcgtgctgcggaagttacagatgacactcaatttgcacaatgggttgagttattactggatcaggcgctgctcgcggagaggggaacattggaagaccctaaccagtttattcgtcgaatgaatcagttactcacggcttaatcgataaaaaaacacccttgttcaacgtattgccaagggtgttttttattgtacctctctgatttaaatctatattttattatttcatttcctcaaatatcttgccaacccacctcacgcgccttgagccaacccccctgaaaatggtatggttgcttgttttccacaatttctatttatttaagtaaaaacacatagaaaaactacaagcaaggggatttacgcaatgcgtatcattctgctgggcgctccgggcgcaggtaaaggtactcaggctcaattcatcatggagaaatacggcattccgcaaatctctactggtgacatgttgcgcgccgctgtaaaagcaggttctgagttaggtctgaaagcaaaagaaattatggatgcgggcaagttggtgactgatgagttagttatcgcattagtcaaagaacgtatcacacaggaagattgccgcgatggttttctgttagacgggttcccgcgtaccattcctcaggcagatgccatgaaagaagccggtatcaaagttgattatgtgctggagtttgatgttccagacgagctgattgttgagcgcattgtcggccgtcgggtacatgctgcttcaggccgtgtttatcacgttaaattcaacccacctaaagttgaagataaagatgatgttaccggtgaagagctgactattcgtaaagatgatcaggaagcgactgtccgtaagcgtcttatcgaatatcatcaacaaactgcaccattggtttcttactatcataaagaagcggatgcaggtaatacgcaatattttaaactggacggaacccgtaatgtagcagaagtcagtgctgaactggcgactattctcggttaattctggatggccttatagctaaggcggtttaaggccgccttagctatttcaagtaagaagggcgtagtacctacaaaaggagatttggcatgatgcaaagcaaacccggcgtattaatggttaatttggggacaccagatgctccaacgtcgaaagctatcaagcgttatttagctgagtttctgagtgaccgccgggtagttgatacttccccattgctatggtggccattgctgcatggtgttattttaccgcttcggtcaccacgtgtagcaaaactttatcaatccgtttggatggaagagggctctcctttattggtttatagccgccgccagcagaaagcactggcagcaagaatgcctgatattcctgtagaattaggcatgagctatggttcaccaaatttgccagaggctattgaaaagttattagcgcagggcgtcaccaacctggttatattaccgctttacccgcaatattcctgttcaaccagcgccgctgtctgggatgctgttgctcgggttctgaaaggttaccgccgtttaccctcaatttcttttattcgtgattatgctgagcatccagcgtatatttcagcattaaaacagagtgttgagcgctctttcgcggaacatggtcagccagaccgattagtcatgtcttttcatggcattcctaagcgctatgcgcaattgggtgatgattatcctatccgctgtgaagataccagccgggcactgagggctgcattacctctgcctgccgagaaaatcataatgacttatcaatcccgctttggccgtgaaccctggttgacaccttataccgatgaaaccctaaaaagtttaccttctcaaggcgttaagcatattcagcttatttgcccaggtttctctgccgattgtctggaaactctggaagaaataaaagagcaaaatcgagagtttttcttgcatgcgggcggagagaagtttgaatacatcccagcattgaatgacgacgaggggcatattgccctgttagaacagttaattcgacataatatataatcgctgctaaacattacatcttttggtagtttatcacactcaaaaatttcacattttcaatccaatgaagaatcagtaaaaaatataaatagtgggtaaaatgttgtcgtggttagtatttgttcattttgatctgatctctttatcaaatagaacatgatgtacatcacatctctcttgtaatatagggatataagtacgattattagcacgaaattttgggtttttatgtcatagggtgcttaacttaacttacatctgtaatttcggaatgctccgacacctgttttaggtaaaagcgcgtaccttcaaggccctgttatggttgtagacctaaagcttcatatcaccagtgcattggtagctgtaagccaagggcggtagcgtgggggggatagaaccccaatagttgccttttactctggaactggcaggaagaagaccttctacaattttttactttagtgatttttaaccgtacttctttatcaaaaattatttgcttttttgtttctattttagtcactgaatttttttgacttaagtttgtattgagtacgtctaataaaccttacataatatatttggacttattttatgtcattaaatgttaagctgcatccatcaggtattatttttacttccgatggaacatctacaatattagatgcggctctggatagtaatatacatattgaatacagctgcaaagatggaacctgtggttcttgtaaggcaatattgatttctggtgaagtagacagtgcggaaaatacctttttaactgaggaagatgttgctaaaggtgcaatcctcacttgttgctctaaggctaaatctgatattgagttagatgttaattattatccagagttaagtcatatacaaaaaaaaacttacccatgtaaattagatagcattgaatttgttggtgaagatattgccattctctccttacgcttgccaccaacggccaaaatacagtatctagcgggccaatacattgatttaattattaatggacagcgtcgtagttactctattgctaatgctccaggtggtaatggcaatatcgaattacacgtacgtaaagtcgttaatggtgtattcagcaacatcatttttaatgagttaaaattacagcaacttttacgaattgaaggtcctcaagggacctttttcgttcgtgaagataatctccctattgtttttcttgctggtggaacaggttttgcaccagtgaaatcaatggttgaggcgttgatcaataaaaatgaccaacggcaggttcatatctattggggaatgccagcagggcataatttctattctgacattgccaatgagtgggctataaaacaccctaacattcattatgtgcctgttgtatcaggcgatgatagtacttggaccggagccactggttttgtacatcaagcggtgcttgaagatatacccgatctcagcttatttaatgtttatgcctgtggttcattagcgatgattactgctgctcgtaatgatttcatcaatcatggattagctgaaaataaatttttctctgatgcctttgtgccatcaaaataactttgagagatcaaagtaatacgtaatggagattcaagtgaaagcagtcattttggccggaggccttggaacccgtcttagtgaagagaccgtagtaaaaccaaaaccaatggtagagattggtgggaagcctattctctggcatattatgaaactttactcttcttatggcatcaatgatttcgttatttgctgtggttataaaggctatgtcattaaagaatattttgcgaattactttatgcacatgtcggatattaccttctgcatgcgtgataatgaaatgatagtacaccaaaagcgagtcgaaccctggaatgtcacgttagtagacaccggcgaagattctatgaccggtggccgactgaggcgtgtaaaagattacgtcaaagacgatgaggctttctgtttcacctatggtgatggtgtgagtgacgtcaatattgctgaattaattgcattccataagagccacggcaagcaagccacattaacggcaacctatcccccaggccgttttggtgcgctggatattaaagataaacaagtacgtagttttaaagaaaaaccaaaaggcgatggcgcattgatcaacggcggttattttgttttgtcgcctaaagttatcgatctgatcgatggtgataagtctacttgggagcaggaacctttaatgacattagctgcgcagggggagttgatggcgtttgaacatgccggtttctggcagccaatggatacgttgcgtgacaagatttatctgcatgaactatgggaagaaggcagggcaccttggaaggtatgggaataacaaaatgattaataatagtttctggcaaggtaaacgggtttttgtaacaggccatactgggtttaaaggtggctggttgagtttatggttgcaaaccatgggggcaaaggtaaaaggttactctctgaccccccccacggtgcctagcctatttgagaccgcacgagttgccgacgggatgcaatcggaaatcggtgatattcgtgatcaaaacaaattattagaatcaatccgcgaattccaaccagagattgttttccacatggctgctcagccactggtccgtctatcctattccgagcctgttgaaacctactcgacgaatgttatgggtaccgtttatttactggaagctattcgccatgttggtggcgtcaaagcggtggtcaatatcaccagtgataaatgctacgataataaagagtggatctggggctatcgcgaaaatgaagcgatgggggggtatgatccttactccaacagtaaaggttgtgcggaattagtgacgtcatcctaccgtaattcgttcttcaatccagcgaactatggccagcatggcactgccgtagcgacagtgcgtgcgggtaatgtcatcggtggtggcgattgggcattggatcgcatcgttccagatattcttcgggcgtttgaacagtcccaaccagtgattattcgcaacccacatgccattcgcccatggcagcatgtgttggagcctttgtcgggttatttgctgttggcacagaagttatatactgacggtgctgaatatgccgaaggttggaactttggtcctaacgatgctgatgctactccagtaaaaaacattgttgaacaaatggtgaaatattggggagagggtgcaagctggcaattagatggcaatgctcaccctcatgaagctcattatctgaaactggattgttcaaaagctaaaatgcaacttggctggcatcctcgctggaacttgaatactacgctcgaatatattgtgggctggcacaagaactggttatcaggcacagatatgcatgaatacagtattactgaaattaataattacatgaacactaaatgatttgaggtcatagataaatgagtcaagaagaattacgtcaacagattgctgagctggttgctcagtacgctgaaacggctatggcccctaagccatttgaagcaggtaagagtgtcgttccaccttcaggtaaagttattggtaccaaagaactccagttaatggttgaagcttctttagacggttggctaacaacgggccgttttaatgacgcttttgagaaaaaactaggcgagtatttgggcgttccttatgttctgactacaacttctggctcttcagccaacttattggctttgaccgcgctgacctcacctaaattaggggtacgggcgttgaagccaggtgacgaagttattactgttgccgcaggttttccaaccacagtaaacccaactattcagaatgggttaattcctgtctttgttgatgttgatattccaacttacaatgtaaatgctagcctgattgaagcggcggttagtgataaaaccaaagctattatgattgcccatacattaggtaatctattcgatctagctgaagttcgccgagtagctgataaatataacctgtggttaattgaagactgctgcgatgcgttgggttccacctacgatggaaaaatggctggtacatttggcgatattggtaccgttagcttctatcccgctcatcatatcaccatgggtgaaggtggggcggtatttacacaatcggcggaactgaagagtatcatcgaatctttccgtgattggggtcgtgattgttattgtgctccaggctgtgacaacacatgtaaaaagcgtttcggccagcaacttggctctttaccattcggttatgatcataaatatacttattcccatttaggctataacctaaaaatcacagatatgcaggctgcctgtggtttggcgcaactagagcgcatagaagagtttgttgaaaaacgtaaagctaactttaaataccttaaagacgcactccaatcttgcgctgactttcttgagttaccagaagcgactgaaaattcagatccatcatggtttggtttccctatcactctgaaagaagatagcggagttagccgcattgatctggttaaattccttgatgaagctaaagtgggaactcgcctactctttgccggtaatttaactcgccagccgtatttccatgatgtgaaataccgtgttgttggtgaattgacaaacaccgatagaattatgaatcaaactttctggattggtatttacccaggcctgacacatgatcatttggattatgtcgtgagtaagtttgaagagttctttggtttgaatttttaacaggagcaaggaggcaacactgcctcttttttttatatgaaaattcttattaccggcgttagcggttatttggggagccaattagccaatgctttaatgctagagcatgaagttgcgggaactgtgcgtgctggttctgtatgtaatcgcatcactgatattggtaatgttaatttaattaatgttactgacagtggctggatagataaggttttgtcattttctcctgatgtggttattaatactgtagcattatatggaaggaaaggagagttactttcagagctggttgatgccaatattcaatttccattacgtatattagaaatgttagtttcaacaggaaaaggcttgttttttcagtgcggaacatctctacctgcggatgttagtcaatacgctttaactaaaaatcaattcactgagcttgccagagaatattgcaataaatttagtggtaaatttatagagttaaaattagaacatttttttggtccttttgatgattcaactaaatttacaacttatgtaatcaatagttgtagaagtcatagtgacctaaaattgacagccggcttacaacgccgtgattttatttatattaatgatcttatcaacgctttcaaaattatgatttcaaaatcagagagtctaatttcaggcgaaagtatttccattgggtccggtcatgctgtcacgataaaagaatttgtagaaactgtcgcaaagatgacaagttaccaaggcaatctacagtttggtgcaatccctactagagagaatgaattgatgtatagctgtgcatcattggcgagaatacaggaactcggttggttgtgccaatattcattaaatagtgcaattaaagatacactaaacagaatgcgggtctgaatggatatgaaattttgtaaaaaccgttatatcaatacagtcattttaggggcaggcgttgcggggttaggtgcagctctgaaagcccgtgaagtaaatattgaatatgaaatttttgaagcaaaaacatctgcgggtggtttgttagacaattttgtcattgatggatatcgttttgataatgcagttcatcttagttttgctacagaagagaaggtaagagatgtttttgatagaacaccttatttctctcattctccagatgctgtaaattttgaaacagataagtggttaaaacatccagtgcagaataacctttatcctcttcctgcaattgagaaagtcacactcattgagtccctgattcatcgtcctgagagtgagcttgctgataactacgaatcttggttaattcaccagtatggtaatgaaattgccaagcgataccctatgcgttatacacggaaatattggcagtgtaatgcgaatgaactatcggttagttggattggtaatcgtctacggcgagctaagctgtcagaaatattatatggcgcattcactgatgatactcctaatgattattatgcaaaagaaatgcgttatcccaaaaaaggagggtttaaatcttttattcaacctcttatagatgagagcattattaactataattatgaggttactgagattgacttatctgggaagactatcaaattctctaatggagtcataatcagttatgaaaatttaataaatacattaccactaccactgtttattgagttttgtggagctaatgtacctacaagcgtcaaaaaatccgcaagtaagttagaggcaacatcattagatctaatatctgttggcttcaacaagtctatcattaaagatttatggttttatatctatgatgaagatatttatgcaagtcgcgcatattctccctctgttaaatcatcggataatgttcctgacggttgcagttcgttacagtttgaaatttataatcccgggagagatagccagtatactgtacaggaattgaaagacaatgttatttatgcaatgaaaaaaatgggagttgcaaataatgaagatattgttttcttgcatcacaagcgtctcccatggggtaatgttgtattcaaaaaagatatggaaaagtatagggatattgttcgagaatacatttttgacaatcaagtgaaaagtgtaggacgttttggtgaatgggattatttatggagtaatcagagttttcttagtggatatagttcaatttaataatttaataattaaaagttaaaagttaaaagttaatataccatgattaattttctttaaagttaaaaataaataattgcaggctaaaatgaaaataaattatcaaatggtatgggggttattaaatcaaggatgtaatatattcattccatttgtaataatgtttatgtcttataagtatctccccttagaaacggctagtgtatgggttatattcttatcgatgatatcactaattactttgtttgattttggtttgtcaccagcaatagtcagaaatgttagctatgtgatatctggagcgcaaaatctagttaaaagaggaatagatgatattattataaaagatgtaatatcctaccctcttctatctagattgttatttgatataaaacggatttatttatacctatctataatagcgttttttattatagtcattggcggtctttggtatttttattatatatcacctctggatataaaaaacgaagttgcatattcttggcttttgttttcaagtacgctaatcataaatcttatttatttatattacgttcctgtattaactggcttgggtgaaattgaaagttcgtataaggcaaatgtattaggacgaatcacttggttaatattaactttattagcactaaccttgttgccctcaattttaattttatctttatgcttttctttttcagtattaattaatagatatatatgctattttttctatagaagaaatttccatataaaaaacctagataaaatagatacgggagtagtttctacaataccgttcattggtcacaatgcggctaaactaggtgtggttagcttgggcgcatttttgataaatcgttcgactactttgattgtaggcattgtttgtcccatcgtcacagctggtcaatttgtactaagtatgcaggttttctttgctttaatggctataagtaatattttattaagtataaaaatccctgaaatatcgcaggccgtagccaaaagggaacactatattgtaaagattctgatatataaagtggttgctttctcttcgagtatttatctcttgggatttgtaacatttttaatcttggcagaatatgtacttcctacgattggagtgagtttatcgtttctcccactcgactaccttctcattcttggattaatctattttttagaaatgaatcactccatttgcgccacaataataaccagtaaaaataatgtcccattcgtttttgcatcgctattttctggtggattgataatactttcatctataatattatcaatccattttaaatatggcgtggtcggattaattttgtctcaagggattgtccagttgatgtataataattggaagtggccattaatggtttatcgtgagtttattaaaaataatatagaggataggtgatagtagctttatgaaaagtaatattataattgataatagtaactcagatgatgttctattgactatagcaatacccacatataagagatttggtttattaaaggaaactctaaaaagtgtattttcactggaatttaatattccaatagaagtaattattgttgataacgatccagaacatcctgaattagtgttgtcagaaatggcagagtttgaacgtcatgattttatatattataaaaatatagaaaactatgggatgtttggtaattggaatcaatgcttgaatttggggagagggaagttaattactatattacatgatgatgatctattatgtgttaattttcctcgtgagttagaacgattcttaaaagaacatggttgtcatgatgatattccgttgataggttttggacaccatttattagatcaaaggaaaagtgaagataaagttaataagaatattttgtataaaataagcaaaaatatatttaatatttacagaaaatatttgataaaaccaaaggtggtttctataacattaaatgaaattttttggggaaatatatttagcggtacactcggagttgtaatggataggaataaggctttatctatttcaggcttcgatgaaagaaattatcctgtcagtgattatgatttttggattaggtggattcaaaagtatggaccaataaaatataataaaactaaagtctcctattatagaattctcgataatgaaagtatgaggccagatgttatttcagattttataattaaaaattataatttaagaatgaggattattaatgaaaacccttcattaattagtcaaaaggctaatgtttcatatttaaaaaaacttgatgaatatagttttaatattgcttggagaaaaggtgggagttataatttaggttttttggggactattcagtacatatatattaaagttagatgtggtattcttaagcgattgagttgttaagtaaaccgtattataactacatcaccatatggaattattttctagaggtatcatctagatagagttagacttcatttttaagtaactatattttaagattggaataggattgtatctttattgatgaaattattgaatatgaactcatattaactataaaggctcttcgtcgtgatattaagaaagttttttattatttgtgatacagtctatcccgatgactccggtggtagaaaactatcattagggcgtatattcgaagcaaaagaaagtggtttcaaagtaagtgttcttcactataactacacaaattcggatgtaagtatagcaagacagttctttcttgaacataatattgactatttttactacatccctgcattctcacacaaaaaaagtaatttagttagatgtgctaattatatttcttcagttataaagttaactccagaaccatattattatataatgaaagattatggatttaagaagtttgtacttgataattttgaaatgagtaaaaattcaacattatcaattgagtctattttactttcagggcttcttccatggtttaatacgtttgaaggaagtattgagttagtttttcataatgtagaatcggatttttaccgtcaactctcgatatctagtcgatcaattatatataaaattttctttttcatagaatctatgaagttatcagctatagaaaagtatttgtttaatattaaagatgaaaatatttattttgtttttttgagcgaaaaagatcttgaaaaatatcgattaatttttcctgagtttcaagcggatatttttattaataaaaataatttatttataaaagaaaaaataaaaagaagtgttaactttaataaaccattttttctttttccaggtgggttaaattttccaccaaatagatatagtctaaactggtttttagctgccatgtcaaaaagggtctctagccttggcgttgatatattagttacaggttcgtttaatgatgatattaagtctcagtttagtcagtattcttgtgtcaagttagtcggatatgtatcagatatacaattacgagaattgcaaagctcctgcatagctgttatttctccaattataactggaggtggagtaaaaataaaaaatatagaagctataaaattaaaaatccccttgattgcaactaaattttcttgtgaaggtattgatgaacgaggggctaatatttatattactgatgatgaacctggttctttttatattacgatgaaatcggttcttaataaaactatgagctataaatgaataagactatctcactatatatttctctatatagcatcgcattatggattggtttttttgggtgtatcaatacgggattttttagtggtgatttaaaaggagttaaagtatctctcaataattatgagttatttgtcattgctattatttatcaatttattatttttctatcttttctcatttttttaattgtgactcgttataaattcactttaggtaagtattgtgttgaaattgttaattttaaattttcaatactattatttgttgttttaataatgcatattgcttttgtttcatataccggagttggtaaggtttttggaggaaatactaatatctttagtcccatattttctattacagcacccagtgctatattctttttctattaccttattgttagagaaaatgccggaaagattttttttattaatgtgcttctatttgtattacttgagttattaaaaggatggagtggttttttacttacaatttttatgttcgaaatttatttttatataaaaagaaactcaagtagtcgtctattgaaaattccatttttattttctataacattaccatttattctactgttatctggtggttttttatataagcatatttatatacttaaaaatgacataaggggaattagtgttgtcagtgataatttagaatatatagatgcagtcgaaatgttatctgatagactaactaatttctcgacagcagctggtgtatactctcgatatgacagcgtagtagatatcgcaaagttgcaaaatgaatatgcagagataaaaggtttttttaggcctcttgtaccaaacttcattatggagaacaaaagttttagcgcactgaataattctgcaatgcttgcatttttccctgactatagagatgattcaagtgtcgatttaggattcgtaatgtattattatgtcctatttgaatcaagagttagtgatgcatttttatcgttgtttttatcgttttttttatgtgtggttctcagtgttatttttaaagtattgtctaaaaacaatcaaaatataaatttattgatttttataatgatattttctttgctttatacatcatctaatgaaatggtcttcgcaagagggaatataattattttattttatatacctatgctttttttatttgggatagctagggtgaaaattaaatcagttgccataaaataaatattaacttttttgttttttgtatgatcatttcattaattacatgcgataattaatgattttaaatatatttatttttaatgtctaagttataaatgtatttttaataaatttaatttttatatattataagtgagtgagttatattttgcgattagataataatttattaatttcttaacactacgtttgatgtttagtagtgaactatattgagtattaatttgcaagttaattataggttctctatgaaaattatttatgatggaataattaattcattgcaaaatatgggaggggtaactgtctatttctcggagttagtgagtcgacttcctgcaacagatttttattggtactcatacgcagatgaaatatctggtttcggtgttggtaatgttaaaataaaatctagacttttagagcgatataggaatttctcattagatactattaattataattctctttctgtatttcattcatcatattaccgattaccagattttgacattccgatagttacaacagttcatgatttcacatatgaaaagtttgttaatggccctgcaaaatgggtgcattcctggcagaaaaaccgtgcggttaacaatagtgatttaattatttgtgtttcggaaaatacagctaaagatttgcaaatgtattgctcagttcctagcaataaaatcagagtgatatataacggtgtgtcagataaatatcattatattaagggtgttaaaataaccacaaataaagttatttttgttggtgcgcgtggtggttataagaattttgacattgcagtgaaagcaatatcaaaaacacctcacctcgaattatcagttgtaggtggaggggcattcactagtaaagaactgtcactactgaatcactatttacctgggcgctaccatggattaggacgtctgagtgacgaggccttgaatgaggcatataattcagcttatgcgctgctttacccatctagctatgaaggttttggtattccaatattagaagcgatgagtgcaggatgtcccgtaatatctgttaatgtatcttctatacctgaggtcgcaggtgatgccgctatattagtgcaaaaaccgactgttgatgaactagttgacggcttgcttgccgtagaaagtgaaaggtctaaacttattggctatggcatgaagcaagcggctaagttctcatgggataagtgttatcaagaaaccttagatgtttataaagaattgaacaaataaaatggattacaatatatgactaagattgcgctcattactggtattacaggacaagatggctcttatttggctgagtttttattagaaaagggttatgaggttcatggtattaagcgccgagcttcatcttttaataccagccgcattgatcatatttatcaagatcgccatgagacgaatccacgcttctttttacattatggtgacttgactgacacgtcgaatttaattcgtttggtccaggaaattcagcctgatgagatttataatttgggtgcacaatctcatgtggctgtttcatttgaatcaccggaatatactgccgatgttgatgccatggggacactgcggttgctagaggccattcgtatcaatgggcttgaaaagaagactcgtttctatcaagcctcaacctcagagctttatggtttagtgcaggaaacgcctcagcgtgaaacaacgccattctatccgcgttctccttatgctgttgccaaaatgtatgcttactggattacagtaaattaccgtgaatcatatggaatgtatgcttgtaacggaattttatttaaccatgagtctcctcgtcgtggtgaaacatttgttactcggaagattacccgtgctgttgcgaatattgcattaggtctagaaaaatgtctctatttaggcaatatagattcgctacgtgactggggccatgcgaaagattatgtgcgtatgcaatggatgatgttgcaacaagataagccagaagattttgttattgcaacaggcaagcaaattaccgttcgtgagtttgtacgtatgtcagcaagagaagcagggattgaattggaatttagtggagaaggcgttgaagaggttgccactgttgttgctattaatggtaaccatatttcttctgtaaatattggagatgtaatagtccgtgttgatccacgttatttccgtcctgctgaagttgaaacattattaggcgatccaactaaggctaaaaaagtattaggctgggtacctgaaattacggttgaagaaatgtgtgctgaaatggtcgctagtgacttagagcaggctaaacagcatgcattgttaaaggctaatggctttgacgtatccatttcgttggagaattaatacaaatggataagaaacgcgtatttattgccgggcatcgtggcatggtgggttctgctattgtacgtcaacttgaaaaccgtaatgatattgaattgatcattagggatcgtactgaacttgacctcatgtctcaatccgctgtgcaaaaattttttgctactgaaaaaattgatgaaatctatttggctgcggcaaaagtgggggggattcaggccaataataattatccggcagagttcatctaccaaaacttaatgatcgagtgcaatattattcacgcggctcatttagctggcattcaaaaattattatttttggggtcttcttgtatttatccaaaattggctgcacaaccaatgacagaggaggctctgttaactggcgtcttggaaccaacgaatgaaccttatgccatcgccaagatagccggtatcaaactgtgcgaatcttataatcgtcaatatggtcgcgattatcgcagtgttatgccaaccaacctttatggtgaaaatgacaattttcaccccgaaaattcccatgtcattcctgccttattacgtcgcttccatgaggctaaaattcgtaatgataaggaaatggttgtgtggggaacgggtaaaccaatgcgtgagttcctgcatgtagatgatatggctgctgccagtgtgcatgtcatggagctgtctgatcaaatttatcaaaccaatactcaaccaatgctttcgcatattaatgtcggaacgggtgtggattgcactattcgtgaattggcagaaactatggctaaagttgttggtttcaccggaaatttagtttttgattcaactaagccggacggaacaccacgaaaattgatggacgtaagccgcttggctaaactcgggtggtgttatcagatttcgcttgaagtaggtttaacgatgacttatcaatggttcttggctcatcagaataacttcagaaaatagtttcatttgctatttgctatttggatatggcgactcttaagttggttaattaagttttaacttaataagtaaaaaatattatcgggtttctatttattattcgttatctgatgattatatttatttgcatatcatctctattttaaaaataggaaataattgctcatgctattacctgtaattatggctggaggtgctggtagccgtttgtggccattatcccgagctctttatcctaaacaatttctagcgctaacgtcagatttgacgatgctacaagaaaccctattgcgtctggacggtcttccccaccttgcaccattagtgatttgtaacgaagaacatcgctttattatcgcagaacagttgcgtcagaaaaatctggtgcatagcggaatagtcttggaacctgttgggcgcaataccgcgccagctatagcattggctgccttacgagcaacaatgagtggggatgatcctctattattggtattagcagccgatcacgtgattcaggataaacttgcatttattcgtgccgtccaacgtgctgaaccgcttgctgaagcgggaaaattggttacttttggaatcgtgccaaagagtccggaaacaggatatggatatattcgccaagggaagcaagtcgtagatggcgcttatcaggttgctgcttttgttgagaagccagatctgattactgcagagcggtatttggcttcgggtgactattattggaatagcggtatgtttgtatttaaagcatctcgctatctacaggaattagatctacatcgtccggatattttggctgcctgcaagcaagccattgctggtcaacatactgatttagattttattcgtctcaatgaagaagctttctctagttgccctgatgaatctatcgactatgctgtgatggaaaaaactagcgatgccgttgtagtgccactggatgcacagtggaatgatgttgggtgctggtcagcgctttgggaaattaatactaaagatgaccatggtaatgttattcgtggtgatgtattaatagaagatactaataatagctacgtttattctcaaaataggctcattgcaactgtaggcattaatgatttggttattgttgaaactaaagatgccattttagttgctcataaagataaagtacaaaatgttaaagggatcgttggacagcttaagcttgaatctcgatgtgaatatctacagcaccgggaagtctatcgcccttggggttcgcatgatgctattgctgaaggtgttcgctaccatgtccaacatgtaacggtgaaaccaggtcaacgtattgctactcaaattcattatcacagagcggaacattggattgtggtttctggcattgccaaagtacattatggaaaagaaacttatttggttaatgagaatgaatccacttatattcccgtcggcattgctcattctattgaaaatccaggtcagatccctctggaaataatagaggttcatactggtaattacatttcagaagatgatgtggaacgaatcgatgatttaggtgtagggtattaattatgaagataagtattattactgctacatataatagtgagagaacaatttcggataccctatcttctttggagaaacaaacctatctggatgttgagtatattattgttgatggtgcatcaaaggataatacattaactgttattagtcagaattctacgcgagtcactaagattattagtgagtctgatcaaggtatttatgatgctttgaataaagggatagatttggcaacaggtgacattattggttttttacattctgatgatttacttgcctatccaggggccctatctgatattgtagaaacctttgaaaaacagcaatgtgatgctgtatatggtgacttacagtatgtcgcaaaaaatgatttaaataaggtaatcagatgttggaaaagtggtttttttaaccatgaaaaaatgaagtatggttggatgcctccccatcctactttttatatgaaacgagatctttatataaggtttggaggttttgacttaagttataaaatatcagccgactatgattctcttacgcgttatataatcaattataaaattaaaattgcttatttacctaaggtaattattaaaatgagagttggggggataagtaatcggtcattgggaagtatgttgttaaaatctaaagaagatatacaaataatgaaactccgtgggctattctggcctatgtcgtttttatgcaaaaacttatctaaacttcctcagtttttaaagtgatcttatgccaaaactaacctgttttaaagcctatgatattcgtggccgattggatgatgaattgaatgaagatatagcttaccgtattggtcgcgcgtatggtgagtttgctaaacccaaaaaggttgtagtagggggggatgttcgattaaccagtgaaagtcttaagttagcgttaagtcaaggtttacaagatgcaggtactgatgtattagatattggtttgtcaggtactgaggagatatatttttccaccttccatcttggggttgatggtggtatagaagtgactgccagccataacccaatagactacaatggaatgaagttagttcgtgaaggctccaggcctatcagtggagatacagggttacgggatattcagtatttagctgaacagaatgagttccctccagtggatagtgaaaaaagaggtggttataaaaaaatatctattattaatgactatgttgaacacttaattaactatattaatccttctctttttaaaccgttgaaattagttgtaaatactggcaatggtgctgctggtcatgttattgatgctttagaaaaacgtttttcagaattaaaaataccgataactctgattaaaattcatcatgagccagatggcacattcccgaatggtattccgaatccactgttaccagaatgccgccaggatactactgatgctgtgctgatgcatgacgctgatatgggtattgcctttgatggcgattttgaccgttgtttcttctttaataataagggtgagtttattgaaggttattatatcgtggggcttttagccgaagcttttcttcaaaaaaatgctggagctaaaattatccatgatccacgtttaagctggaatactattgatatagttaattcttctggtggaacgcctataatgtccaaaaccgggcacgcttttattaaagaacgcatgagagaagaagatgcggtttatggtggcgaaatgagtgctcatcactacttccgcgactttgcttattgtgattcagggatgattccatggttactgattgctgagcttttatgtgtcaaagaaaaaagtttggagcagttagttgaagagcggatgcgtatttaccctgcatctggagaaattaattctaagttaaccgatccaacctctgcgatagcgcgtgttcgtgccgaatatgaagttaaggctatagctattgacgaaactgatggtattagtatggaatttgatgggtggcgttttaatttacgcagttcaaatactgaacctgttgttcggcttaatgtggagtcacattacaataagacattaatgcatcataaaacagcagagatactttctctattaagaaaagaataattattttagatggcattcctagcattactatatataggtaatactcaatgagtaataaacaggcacgaaataaccttgataacccaatgccgaataactatgatttttcaaatgtatcttcttcaagaaatgaaattgatctctttgaaatttttggtgttgtatttaaatcaaagttcaagataatattaataacactatttttcttaattagtggtttagtggtctcatatatcctcccccaaaaatggacaagcactgcaataatagctcttcctggtgatgagcaagttcaagttctggatgaactaatcacaaatctgaccgtgcttgatataaaggttgatgtgagtgctaattatttgctgtcaacattcaaacaaaatttcgattctcaagatctccgtgaacaatatttagtaaatactaattactttaaacgtttgatgaagaataatccagaagatggtttggataaaagagcgttaatagagcgaatcgtaaatgaaaatatttcttcggttaacccattgaaagataaaaccgagggtgaaaatgaatatcgctattataaattatcatatagtgcaagcacaccgacagacgctcgtgacttgttgcaaggctctattaactatgtaaataccatcgttaatgctgatgttttccgaaaaatacagcgagcagtggatttagccaagggtatcggtacagataaatactctatggaattattgaaagctagaaataaccaaaaagttaaaattgagcgcttaaggtatgcttcttctatcgctgatgccgcaggcgtaaaaaaaccagtttacagcaatggctcagccattagtgatgatccagacttccctattactatgggatccgatgcgctgaaccgtaaactggaaatagagaagtcagttatcgacctggcttcaatcaatactgaacttctaaaccgtaagttgtatttggataaattaaataggttagaaattcctaatgttaatattgtgccatttaaatatttgcaacagccaacggaacccactaaaagagatgcccctaagcgcgcattgattgtgattctgtttgccctggtcggtcttatgggttctgtcggttttgttttagttgagcactttgtgcgtgaacggaagcgagaagaagaggggcttaagctctctcaaactaaggaataggttttaaacgaatttatctaacggctgggtgaggtttctcatctggccgttctgttttatcgctctgtattattttactatttttccgtttttaagttagctgctactatttgcttgtaactaattcccctgcattatgcttcccagcaacccttatgctaaaattcgttatcttttcatcgctagatttttaactcaaaacaatgaaatttcctggtaagcgcaagtccaaacactactttccagtcaatgcccgcgatccactattgcaatcggtgcaggctgaaaatgaagtgagtacctcttatatcgttggtattgaccagacactggttgatattgaggcaaaagtcgatgaagacttcattacgcgttatggccttagccaagggcattccttggtgatcgaagatgatgtggctgagcgcctttaccaagaattaacccataatgatctgattacccatgaatttgccggtgggactatcggcaatactttgcataattattccgtgttggctgatgaccgatctgttttgcttggcactatgtgcagcaatattaaaatcggcagttatgcctatcgctatttatgtaatacctccagccgtaccgatctgaattatttgcaggcggttgacggggcgattggtcgctgttttaccttgatcacggaaaatggtgaacggacttttgctattagccctggtcaaatgaatcaattacgtccggaaagtattcctgaagaggtcatagcaggagcctctgcattagtgctaacggcctatttggtgcgctgtaagccaggggaacccatgccggatgccaccatgcaagcgattcactatgcaaaaaaacatgatgtcccggtagtgatgacgctagggacaaaatatgtcattgcagataatccgcagtggtggcgtgaattccttaatgaacatgtctctattttggcgatgaacgaagatgaggcttatgagctaacaggattgaacgatccgctgatggcctcagatatggcattggaatgggtagatttagtgttatgtaccgcaggccccagcgggctttatatggcgggatataccgaagaggcctataaacggcagactcagcacccattattacctggggctattgctgagtttaatctttatgaattcagtcgggcgatgcgtaaagcgcattgtgtggatccgttccgtatctattcacatattgcgccttatatgggcgggccggaaaaaataatgaataccaatggtgcaggggatggcgcattgtccgcggtcctgcatgatattactgccaatggttatcaccgtaataatgttcctaactccagtaagcatgtacgcagttacctgagttattcctcgctggcacaggtgtgtaaatatgctaatcgggtgagttatcaggtattgaatcagcattcgccccgtttaacccgcggtttgcccgaacgggaagatagcctcgaggagtcttattgggaacggtaatcaggtagacgcgggatataagtcagggccagcatagtaagctggccctgattgtttttattacagagtaacggaggggctacacggtaatgccgtttaaatcgggcaaaccggcattttatcttcttcagtcagtgtttctattttcagcatattgagcatactgttggcaatttcacgctcgcccatgaccacttggttggcaccacggtcagagatataaacgacttcgtcatcgtaatgtgcacgggcgattatctctagatcggggcgcttaattctggccgatgcgacaatttcccctgcttcgtagccattgggtatggtcagcaataaccaacgggcacaatccaggcgacccagcgccataacatcggcgttggccgcgttgccgaagaccgcgttaataccttgttcccgcaaggcttcgactctgggccgtgagttttcgataaccaccagtgggatcccttcggcatgcaacttggcacctaataagctgccaacacggccgtagccaaccaaaaggacatggttacataaatcaacggggatctgtttctcttcctcgacggcctcttccaggatcaaatcctccatggtctctgtcttagccaaataacgatcaagtaaggtgaagagtagcgggttaagcataatagacaggatcgcactcgccagtaccaagttacggccatgcccagacagtaaaccgagagaaatacccaacccagccaaaataaaggcgaactcgccgatttgtgccaaactgaccgaaatggttagggcggtccgttttgagtgaccaaatagccgtactagggcgaaagcgatagcggatttaccaaagatgataatggccagcgaggcgataacggccaaaggttcattgaccagaatcattgggtcgaacagcataccgacagagacgaagaacagcaccgcaaacgcatcacgtagcggtaaggtatcttgtgccgctcggtggctgagctccgactcattcaaaaccatccccgcgaagaatgcgcccagagcaaaggagacatcaaacagctctacggcaccgtaggcaatccctaaggccaaaaccagcacggctaaggtaaacagctctcgtgagccggtactggcggttttagccaatatccatggcaccaggcggcggcctacgacaatcatcagagtaataaaggcgataactttaccgatagtaatcgctaactcagtaaataattggttcaggttggtcgtttcgttccccatcacgcccgcaaaagcagggaggagtaccagcgtcaataccatggccaaatcttcgacaatcaaccagccaatcgcgatttgccctcgttggctatcaatcaattgccgttcttccaaggcccgcagcaagaccacggtactggcggttgataggcacagaccaaagaccagcccggtgatcagatcccaacctaagaaatgtgataatcccatccccaacagcgttgcaacggcaatctgggcgattgcgccgggtatggcgattgattttacagcgagaagatctttaagcgagaagtgaagtccaacaccaaacatcaacaaaataacaccaatttcagccagttcaggtgctaatgatgtatcagcaacgaaccccggcgtgaatggcccggccagcaccccagctgcaaggtaccccaccagtggtgagatgcgcaggcggtgagccagtgtgccaaagaggaaggcgagaaccaggcctcctacaatagtggtgattaagggtgttgaatggtgcatccagactccttctagctatgcgggtgataagcatttcacagcaataacatcagtttattgcatttatgcgatcaatgcgcgataaaaattaatttttatcggtaaatgtcttctttggcatggaaattgtttgaagtggttgtttgtggaggaattgctatttatatcgagcttacataggggaggctcctgaccaaaatagacatttcagtcagggcgatagcgctattactattacttatcgtccaaattaggcagtaaggccgtgaatattcccagtaatggcaagaacgcacatatttgataaaccagttcaatactggttaaatcagcaacataccccagtactgctgcacctattccccccataccgaaagcgaaaccgaagaataaacccgataccatgccgactttccctgggataagctcttgagcatacaccagtattgctgaaaaggcggaagcgagaataacaccaataaatacggttaaaatacccgtccaatacaaagacgcgtagggtaaagcaagggtcaaaggggcaacaccgagtatagaaccccaaataacatattttctaccaatcttatcaccaagaggcccaccaataatggtgccggcggcaaccgcaaataagaaaacaaataggtgtatctgggcactttgtaccgaaacgccaaacttatgtattaaataaaaggtgtaatagctactaatgctggtcaaatagaagtatttagagaatatcagcaccatcaggatggctaacgtactgataattttattttttggtagtgttttggctgatgagatttttaacactttgccatacgaagcacgttgctgcagtttgtaccatttactcacctgcaacagcacgacaattgccagtagggctgcgagcgaaaaccagcccacattgcctttaccgtaaggggcaataatgatggcggccagtaacggaccgagtgcgctgccaaaattcccccccacctgaaacacagattgagccaaaccatggcgcccaccggatgccatacgggcgactcgtgatgattctgggtggaagacagaagagccagtaccgaccaatgctgccgctaataataccaccgggaaggttgtggctactgccagcagtaatatgccagacagcgtgaaccccataccgatgggtaatgagtatggctgggggtgtttatccgtatataagccaatcagcggttgtagtaacgaagccgtcaattggtaagttagcgtgatcaatcctatttgagcaaaactcaatgagaactcagcttgtaataaaggataaatcgccaggatcagcgactggatcatatcgttgagtaggtgagatacgctgatagcacccaaaatagagaaagatgtacgtttgactgaaacattaacgggctgctgacatccggtatcagaacgatcggtcatagtgagtattcacctaataattttgaatgttaatgctattttgataatgaatacatactaggcatattgtatgatttttactacatatgaacgatttgatatcagtttcaatgcgatgagctgatcaccctatagccgttataacgtgcactgtgcgagagtagggtgatcgaagatcatggtttagatctttcgtattcttactcattaaaccagtctttatccgagcgatttttaacgacagacagtatttttaacgacagacaatatggagttttaccatgcgcttttcattaacaaccacattaggtgctttggcggtgtcattggcgcttgctccggggtgggcgagtgcctgggaaaaagataaaacttacgacatcaccatattgcacaccaatgatcatcatggtcacttctggcaaaacgagcaaggtgagtatggtcttgctgcacagaaaaccgtggtggatgaaattcgtaaacaagtggccgcaaaaggaggaagcttattgctactctcgggcggtgatattaataccggtgtccctgaatccgatttacaggatgccgaacccgattttcgcggcatgaatttggtcggttatgatgcgatggctattggtaaccacgaatttgataatcccttgagtgtgctgcgtcaacaagagaagtgggcgaagttcccgctgctgtccgccaatatctatcagaaaggtacgcaacagcggttattcaagccttatgctttgtttgataagcaaggtataaaaattgccgttcttggtttgaccacagatgacaccccgaaggtgagtagccccgagaatgtcgtcgatatagaatttcgggttcctgccgttgaagcgaaacacgtggttgagcaactgcggaaaactgaaaaaccagacatcattattgctgccacacatatgggacattacgatgatggtaaacacggatccaacgccccaggtgatgtggaaatggcgcgtagcttaccggctggctatctggatatgattgtgggcgggcactcacagaatccggtctgtatggccagtgagaatcataggcaagttgattatgttccaggtagtccatgcgtacccgatcggcagaatggtacctggatcgtgcaggcccatgagtggggtaaatatgtcgggcgggctgacttcacattccgtaatggcgaattaacattggtcaactaccagttaatcccgatcaatttaaagaaaaaattgagaaagctgatggcactcgcgagcacgtcttttatacccaagagattgctcaggaccccacaatgctgaaattactgacgccatttgaagagcgaggtaaagcgcaactgggggttaggatcggcagtgttaatggcagattagagggtgatcgcaataaggtccgttttgagcaaactaatatggcgcgtttattattagcctctcaaatagaacgttcaggagctgactttgccgtaatgagtggtgggggagttcgtgactctatcggtgcaggtgatatcacttataaagatgtgctcaaggttcaaccctttggtaatacgctggtttacgttgatatgaaaggtagcgaggttgagaaatacctggcggtggtagccaataagcagccagattcaggggcttatgcgcaatttgccaacgtcagtctggttgctgatggtcagggtgttagcaatgtgaaaatccaaggtgaaccgttagatcctaataaaacgtaccgtatggctacgctcaatttcaatgcactgggcggggatggttatccaagaatcgacaattcacctagttacgttaataccggatttatcgatgctgaagtattgaaacagtatattgaaaaacactcgccactggatgctgagcagtatcagccgaagggggagatcgtttataaccagtaggctgtttattaaagatgtacttatttataatctgccgcaaaccaagctgtaaaaattaagggtatcgcccagtggcactgagtggctgggctataccggttaattacacaagttcaatgacaggctcatcggggagatagtttgcaattgcattagcgatactttgattatcgttattcttattggcattgctttcaaattcatggataagtatatccagtgcctgattgagacggttatcgtgcgctgagttagccactgcgaccaatgtctgaacaacatacttcaaggcaataagatctgcttttatattaagatcattcttgtgtgcatcataacccatattaatcacccgactaaaattgagaacgctgtgtatgcatggcaatcatgcggttatcgttgatgtatctcatgagttttaaactcattgaggttattgacaaagtgcccgcgacggagagaacaggcagatcgtaaagacgccgtaaatacatccatgtaggctcgagccgcgccatccttggcgcggacgctttactcctctgcctatcctcaccgttcaagatcgcgtcatcggggtttgtcagcagtctgatgagttttaaactcattctttccttcatagtctcggtggatcgcaggatataacgtagcgtgaatatgatggagtgatgactcaatcccgcttggcaatatccgcaaaaacaccctgtaataagcggcataaatccactgcggccaattcaatatctaagccgcgcttaccgccagaaacaaagatagtgacgaacttttgagcttggctgtcaatcacggtgggtaggcgttttttctgccctaatgggctgatgccaccaattagatagcctgtcgtacgctgtgccaactgcggatcagccatctcagctttttttgcccccagcgccctggcaacctttttcagatcaagttgggtagctaccggcgtgacagcaacagccaaatttttagcatcgttattgagtgcgaccagcaatgttttataaacctgatcagcattaagccctaactttttaacggcctcatcaccaaaatgcgtttctgctgcatcatgatgatagggatgcaatgtaaacggaaccttttgtttttccagtagaacaacggcaggtgtcataataaacatccaattaaaaatgaagatttattcaggttggttatcttacacatcattgatgcggtacggataaaaattaatccaacaaaatcagcatactgttaataagttacttcggtaatgattaatgtcagttgctaatctaatcatctggttggtaccctatgctggtgctcacattatccgcaaggagtgtgagtgcttaataacaaaaataatgaaaattcctctttgactggccggtagtgatatcggccatttttttattgattgtcggctcgtaacagctctggaagattcccttcaccgtacaaatgtaatgcacctacagcaacgacataacgtccgggggcgagttgttcgagctgttgctgccaacgtttattgcgctgaagcatcagtacatcatacatatcgtggctgaaagtcggggcgagagttgcctgatacttttcaggctggtgctctagccaccagccaatcatggtttgtagcaggcgggcattggtatgccaatggagaagggtgtcgtgcagtaaagagatgccgttatccggtaaggttttgagtaaatcaagctgcatttcagccccttccagttcaataatctctttctcctgcgcccctgcggctttcagtagttgataatcaatgccatattccccacgcaaccccaaacgttgagcctgatgtgcctgcaacattaacgcgacttgccatgccgggagataggtcatcgccagtgggtcactccccagttcttcacagcgtcgctggagttgcggataatattcctcagataatctgtcgactaaaggttcagtaaccgtgctatggccaaaagaagaggttgcgtcggtgatatccgcttcaacaatgagagcgtcagcctgattcaatttattcagtagcgtgtgggggaggggaaacatccctgccgttcccatatgaatgctgccaactaaatgtaggtggcgctcgccaggtagcgtgatatccaaagccgggtaagcataggtggtgggtgtaataatgcccaagaattttgcgatacggcgtaagagtttgtccatgttagtttggctcctttattagcattttctgtatgctatacccttcttacttgaaattgcagcgttgttagcggcactcactcacccgaatcactgacgtgagtcagctcatcgggattcattcgcttgctgcctagctgtaattccaattactttgggtaactctcttcttacttgaaattgtagcgttgttagcggcactcactcacccgaatcactgacgtgagtcagctcatcgggattcattcgcttgctgcctagctgtaattccaattactttgggtaacactcttcttacttgaaattgcagcgttgttagcggcacttacattttggatatcaacgctcaatggcgcacaaaacgatattgtgcgccattgaggtcactgaaagcatttactgtttaggcttaaagcgcagtaaacggttagcgttactgacgaccgtaatggacgacaacgccattgccgctccggcgacgaccgggctgagcaatgtaccggtgaagggatataaaatccctgcggcaatgggaatgcccagcgcattgtagaagaacgcgcccaacaggttttgcttcatgttacgtaatgttgctttggaaagttctaccgcatcgacaacaccgtgcaaactgtgacgcataagggtaatcgccgcggtttcaatcgcgatatcactgccgccccccatggcaatcccgacatccgcttgtgctaatgcaggagcatcgttaatgccatcaccaatcatcgccactttatgcccggccgcttgcagttgcttgatagcatcggctttgccatctggcagaacgcccgcgatcacacgatcaataccggcttctttcgcaatggcattggcggtaatagggttgtcaccggtcaacatcaccagactatagcccaattgatgcagccgctgtaatgcgccgatactgtcttcgcgcaatggatcacggatcgataacagtgcggcgggcttaccattggcggtcagaataaccggtgttgcgccactttccgcttgttgctgtatcaatgattgcagctcgcgggtatcaatctgttgctcttccagtagccgattattgccaaggagcagtggaatgccgtcaacttcaccactgacccccaaaccgcgcaatgtacgaaattggctggcggtggccaatgtcagcccttcagcacgttgtaagatagcgcgcgccagcgggtgatttgatcccgtttccaatgctgccgcccagcccaaagcctgttgctcactgacaccattaaaggtatggattgccactacctgcgggtgcccctcagtcagtgtgccggttttatcgaacactaacgtatcgaggttactggcttgctgcaatgcatctgcatctcgaaccaatacaccaaattcagcggcccggccgacgccagagataatcgacatcggtgtcgctaagcccaaagcacaagggcaggcgataattaacaccgtggtggccaccaccagggtatagaccaactggggttgtgggccgaagaaataccaaatcaggccagcgacaatggcaatgaccaccaccgttgggacgaataccgcagagatacggtctgccaatttgccgatttccggtttactgctttgtgcctgacggactagtttgataatccgcgccaaggtcgtttggctaccgatagcgctagcccgaaattgtacggttccatcttgtacttgtgtccccgcgtggacaatatcaccgactgatttctgttgtgggatcggctcaccagtcagcatcgcttcatccatccacacttcgccctgcacaatctcgccgtcaaccggtacgcgatcgccagtagtcaggcgtaggatcatccccagttggacatcagccagcgggatcaccttctcgccgtcatcggtcactaactttgccgttggtggggccaaatctaacaggcgttcgagcgcattagatgagcgctgtctggcacgttgttccatcgcatgaccaaggttaatcaaaccgatgatcatggcactggcttcgtaataaaggtgacgagcctccatagggaaaacatctggccagatattgacggtgatggaatagatccaggccgcacctgtccccagagcgaccaaggtatccatggtcgcactgccatttttcaggctgacccacgcattacggtagaagtgaccacccgcaaatatcattaccagcaacgtgataatcccgatgataagccagggcgtttgggtttctggcgtcagcgtcatgctaccgccaaacagcccccaggccatcaatgggatacctaacaacagacctaatgccgcttgccattggaagcgcttcatactggcttgcgacatttgctgttgccgctcgcgtcgctccccttcgtcttcaataatttccgcgccgtaaccggcatttttaaccgcagcgattaaggcttcgttattttgggtccctgtgaccaatgcactgcgctcagccagattaacgcgggccacctgaaccccatcaacacgttgcaatgcattttgtactttagagacacaactggcacagctcatccccgtcagtaatagctgaacactctccccttctgaggctgccggctgggccactgattcggtcactggcagcggattgatcaccggtgccgtgctggtggctgacgccgtatcggctgttgaagttgtcgacgttgtatttgtaggtaaagcggtatttgtaggtaaaacggtatttgtatcagaaaccgtacttgtggctaaagccacgtttgttgccggaactgtattcggggccgctgccagagattccggctgagattgggctgagtgtgtcagcggctcagtttttggggagtcgataccttgctgtgtggcgtgatagccagcctgttccactgcggcaatcaatgtctgtatatcggccttgccgtacacgttggcactctcgagggttacatcggcagaaataacccccgaaaccgcttccagcgctttacggacggtctcagtgcaatgcccgcagctcaatcctgataggtgtaattcaacgtccggcgtttgggcttctgtagcctgataaccggtctgtttgatcgtttcaatgagtgcatgagtgtcggcttcaccagtcactttagcgtagtgaacattcacttcagcatggtgaacatcctcacggctttccaacgcggctttaacgcgttgagcacaattcatacaagaaagtccttgtaaggcgagcagtgtggtttgcaacattatttaactccttattgagtaaaaacttactcataaattcaccagaataagcttagtcggtattacctgccccatacattaatgacggtaatattttgttggcccataatatcggggggcggcttttattccgcttgactggcatggctattttcactaaccatagaggttaaaccttccagcaaggtgaaggtcaagggggaataatgaacattagcgatgttgcgaaaaaaaccggtttaaccagcaaagccattcgtttttatgaagaaaaaaaactggtgacgccacctgttcgcacggataacggttatcgcagctacacggccaaacatattgaagagctcacgttgctgcgccaggcgcggcaagtgggttttacactggatgagtgtcgtgaattgctggcattatttcataacccagcacggcacagcgcggatgtgaaagcggcaacattgctaaaagtagcggaaatcgagcaacatattaatgatttgaatcagatgcgtatgcgtttgttagcgttggcagaagagtgcccaggggatgagggcgcagattgcccaattattaatagcctggcgggatgttgccactcaagcagttcgctaccattaaaataatacgctgccgtgaaaataatacgctgccgtgaaaataatacgttgccattaaagtcatgactcgccatctgagcaataagccgcatctttaacgctgccgtgatgaataacccgaatcacctaccagagtaagtgattcgggctgttcgtttactgccttgctgtagtgacaatgacgtgaggatgtcaatgtaaacgctagcgattaacggcacggacatgcaaggtattgccttctaccaaaatcacttcaacttcagttcctgggttaagctcggtagcgcagtaaattcgccaactgctgtcaccgaccttcatccggccatagccatcaaccgttggctcggtcagtgttgcccgtatgccaagcagttgatgattacgttggttaagcatggcaggttgcggtttagtgcgtttactcaaccaataccaccataggaaagcagacacgacagtcagaatggagaacagcacgccttgcatttcccagctaaaggggaacagccataccagaacgccaacaaggacggcggcaataccgctccacaacagatagccactcgctcccagcatctcagcggccaataatagcccgccaagtgatagccaaaaccaatttggatttactgcaatttcctccagcatggttatttacctcggctgtttttactctcaccaatcagttctgcaataccaccgatagcacccatgaggctactggcttccagcggcatcataatgactttactgttattggccgagccgatgtgttgcagtgcatcggtatatttttgtgccacaaagtagttaatggcttgaatatcaccggcagcgatggcttcagaaaccattttagtcgcctgagcttccgcttcagcggcacgttcacgggcttcagcttgcaagaatgcagactgacgttcaccttctgctttcagaatttgtgactgcttttcaccttcggcacgcaaaatagcggcttgacgaaccccttcagcttccagaatatccgcacgcttggtacgttcagctttcatctgagcattcatcgctgaaatcagttcagttggtggacgcacatcacggatttcgatacgggtgattttgatgccccatgggttggtggcttcatcgacgatatgcagcaggcggctgttgatgttatcgcgctgagacagcatttcgtccagttccatcgaacctaagacggtacggaagttggtcatggtcaggttgacgatagccaattccaaattgctgacttcataagccgctttcaccgggtcaataacttggataaagcaaacggcatcgattgccacgttggcgttatcacgggaaatgatttcttgagatggaatatcaagaacttgttccatcacattaattttacggccaacacgatccataaacggtacaacgatattcaggcctggcatcagtgttttggtatagcgaccaaaacgttcgacagtccactgaaaaccttgcgggacgattttgattgcagaaagtacgacaatcagagcgacaacgataagaatagggataactgtgaacatacttaacttcctgtcagcaagaaaaattgtatcttaatattacgtgatggggggttaaatacctaacgaaagaccggtaaatgcgtgtaaagaggaaaaatggcgggaaagcagcataaaactgcgcaggattgccccgcgcagtagcaaatgatggtacaagtacggtacaaataacggtggaaatacgctaatcagtacaataatgcgtagagttggcggcggtatttagcggccagtgcatcgccagtccctaatgcggctaaaatatccattaatgttttacgtgccgtaccgttcgctgcggctaaatcttttttcaggtgacccaatagcagtcccaacgcttcttcgttgcggccaacctgatgcagttgtaaggccaattgcacggctagctcgacgttatccggctgttctgccagttgttgctgtagttgctggatttctggcgtattagccgcttgtttcagtagctcaatttgggcaattagcccctgataacgggtatcacgatcttgcagtggaagggttgccaatacgctttcggcatcttcgctgcggttcagcaaaatttgtgcttctgccagttgcagggcgatttcgctagtttgtgggctgttactttgttgggcgagttgccaggcttctttcagcagtggcagcgcttcagggactttgccttcactcatcagttgcgccgcttcggccgattttagctcttctggttttggcagtacccgctgtagcagttcgcggatcacctcttctggttgtggcccttggaagccatcaacgggctggccatctttaaacaggtacaccgccggaatagagcgtaaaccaaattgcgacgccaccatgggttgtgcatcgcaatcgacacgggccagaataaattgacccgcatactcggcggccagtttatccagtgttggtgtcaattgcaggcagtgctggctgcgttcagaccaaaaatagaacaacacaggaactgacatggattgttctatggcttggtgcaggtttgcttcagtaatttcaatcgttgtaggtgttagcatgaattatttctctcatccgttttaacgatagatgggggcggattgccttgcttcaacccttagtcaatgatctggcttaactattaccgcgcaggactctatctagcatccggccaggtaatagacgacgtagtagggtcaacgcatgggccaccatcgtgaccggataacgcaattgcgggcgtgggctttccagcgcatgacgcaatttgggtaatatggcttccggtggcagtgtaaatcgcttggcgatccctgggttattgaccggcttatcggcctctgcctgattcacattttgggtgaaatgggtgctgattggaccaggttcaatcaggctgacgtgaataccactactctgtagctccattcgcagggcatcagaccaggcctccagcgcatatttactggcggcgtaggcaccgcgccccgccgttgaaaccaaccccatcactgagctggtttgaataattcgcccctcaccgtgaggcaacattgcgggtagcagtaactgtgtcagttggtgggtgccaaacagattagtcgaaaactgcttttccaactgttggcgagaaatggtgtgcagtgaaccgtacagaccaaaaccgccgttattaaacaggccatataaccgcccacccgtcagttcgataacctgtgccgcagcgcgttcgacactggcgctgtcatccaaatccagttcaataccttccagacctaactgcaccattttggcgacatcgtcaggtttgcggcaggcggccagcacgcgataacctctgttttttaaatcttgtgccgctaccagaccaattccactggaacagccggtaatcaatactgctttttgcataactttacctaatgaatgaatctatttgcttaaacaaatggttaactgagcaaggttagtcttgaataaatatacccgtcatacttcaagttgcatgtacgttttcaagttgcatgtacgttggctgtctttgttcaccccagtcactgacctgttgttgaccttaaaataaataagctcctgggggctaccttaattaccgcgttcctgaaactcgaattatttttgggatgccatttctgagtagtcactgaaattaataacaacactgttttattgattggtaagcgaagggattaccgcacttttagtgcgctttcccttttttctagcctgattaacctgtcaaaacagggctaacagtctgagcgatgtttaaatcatatttatttcggatcaacaactaacggcttgagttgttgcgccatccaatccgcgataaacggttgggcatcgccgttagggtgtaaaccatcatcctgcatccactctggcttaacggcaacctgttccataaaaaaagggagtagggggatgtcgaactgttgcgccagttgtggatagatagcggtgaaagcatcagtataacggcggccatagttggggggaatacggatttgcatcaataatggctgggctttcgctgcggttatctgattgataatttcgctcagatcccgttgaatgtcctgcgtcggaaacccgcgcagcgcgtcattggcacccagttcaatcagcacccagcgtggctgatgttgcttgagtagggcgggtaagcgcgccagcccttgcgcggcggtatctccactgatactggcattgaccaccttcggtaacgaaggcgtggcttgccattttttatccaatagcgaaggccatgcctgtgcaataggcaggcggtaaccggcgcttaaactgtcgccgagaatcaatagtgtatcggttgcggcggcacgcaaactgaataatcccaacagtaaaaggaagggaagatgccagcggaaaacgttcttgaagttcatcatcttaataagcacgtcggtcagggtgagcaacagctctccatccttaccggagttgagctggttgtcaaacctgcccagacaattgcgctaattggcgagtcgggttcaggcaaatcaacattattggggattctggccgggctggatgatggcagcagcggtgatgtgagcttgcttgggcagtcattgaccacgatggatgaagaaggtcgcgcgctactccgggcgaaaaatgtcggctttgtctttcagtcatttatgttggttcctacattgaacacgcttgaaaacgttcaactaccagcattactccgtggtgagagtgatcgccaaagcaaagcgcaagctattgaattattggagcaacttgggctgggtaagcgcctttaccatcttcccgcccagctttccggtggtgaacaacagcgggttgcactggccagggctttcagtgggcggccaaaaatcttatttgctgatgagccaaccggtaatcttgaccggcagacgggtgatcgtatcgctgatttgctgttttccctaaaccgggatttcgcgaccacgttgattctggtcacacatgatgaacaactggccggtcgctgtcagcgtcggttgcgcctgcgggacggtaaattgtgggaggagtcatgatttggcgttggttttggcgtgagtggcgcgcgccttcactgctcattgtctggctggcgctcacgctggcagtagcctgcgtattggcgttagggactatcagcgatcgaatggaaaaagggctgagccagcaaagccgcgattttctggccggtgatcgggttctccgggcagcacaccctgttccagaggcgtggttacaggaagcgaagcagcaggggctggcggttagccgccaactctcatttttgaccatgacctttgccggtgatcgcccacagttggctgaggtgaaagccactgatctggcctacccactctatgggaaattagaaaccttacctaaggaggtagagttgcaaccgggtacggtgctggtggcaccgcgattactggcgctactgggggttaaggttggcgacatgttggatgttggcgatacctcgctaaaaattatcggtgagattattcaagaacccgatgccgggtttaatccgtttcaaaccgcaccacacattctgatcaatctggctgatgttgagaaaaccggtgcggtgcaaccgggtagccgtttgacttaccgctatatgtttgctggcaccccggaggccgtgacgcagtttagcgactggctcaccccgcaattaacaccagagcagcgttggtatggcctgcaagaatccggtggcgcattggggaaatccctgcaacgggcgcaacagttcttattattatcggcgttgctgaccttattactgtcgattgctgcggtcgccgtcgctatgggccactattgccgcagccgctatgatctggtggctgtgctgaaaacattgggggccgggcgccgtgctctgcgtcgattgattatcggccaatggctatccgtgctggcattggcaggcctctgtggcagtgtcattggtctcttatttgagaggctattggttcggttattagcgccggtattgcccgcagagttacccactgccgggctatggccatgggtgtggtcaatgggatcattagtattgatttcgttattggtgggggtgcggccatatcgtcaattactcgccactcagccattgcgggtattgcgccgtgatgtggcggccaatgtctggccattgcgttattttattccagtgatgctgttggtggtaattgggttattggcattgctgatgggggggaactccctgctatgggccattctggggggcatggtggtattggcgttgctgctcggtgggatcggctggggcagcttgctgttgctgcgtcacctaacggtaacccgtttatcactgcggttggccattaatcggcttctgcgccaaccgtggatgacactgactcagcttgcggcattttcactctccttcatgttgttggcgttgttactggtgctacgaagtgatctcttggatcgatggcagcagcaattgccaccggatagcccgaactattttttgctgaatatgacgccccagcaggtaccacaagtcacggcatttttggctcagcatcatattcaaccctcgacgttctaccccattgtgcgggtccggttgacggaaattaatcagcaactggctactgagcgagtgagtgaagactcacccggtggtgaggcagttaaccgtgagttgaatttaacctggcagcaggatttacccgcccataatgtattgaccgcagggcagtggcctcctaaagccgatgaagtctcgatggagcaggggattgccgatcggctggggattaaaattggcgataaactgactttcagcggtgatactcagtcatttggggcgacggtcagcagtatccgtcaggttgattgggacagtttacggcctaatttttactttattttcccacccggcgcattggatcaacaaccacaaacctggttgaccagtttccgctatcacggtgatggagaggccttggttcagttaaatcgtcagttcccaacgctgagtttgttagacattggtgcgatgctgaaacaggtcggccaagtgttacaacaggtcagccgggcgctggaagtgatggtggtgttggtgattctgtgtggcaccttgttgctactggcacaggtacaagtggggatgcgccagcgtaggcaggagttggtggtctaccgcacgctcggagcgagtaaacgcttacttcgaggcacattatggtgggaatttgctttactgggcttagtagcggggctggcggcggcgataggtgctgaggccgcgctctgggcattgcagaggttagtctttgatttcccatggcagccaaactggatgatgtggtggatcttaccactggcgggggcgtcgttgctgtcagtgtgcggtggctggctaggggttcggctattgcgaggtcaggcgctctttcgtcgttacgagtagtggattttattcgcgggcagcagcagaggccgcccgcttcttgttataacttatcttgcgcccaacgcagtgcgttttgatactctgcgggtagcaaaggagccagcgcggccagggatgcgcttaatgccgtaccctctggatcgtttaaattcagatgaccaactttacggccttcacggacttctttgtcgtaccaatgcagatgcactaatggcagagacagccactgaatattcactggcgtgccaatcagattaaccatcgctgacggggtgttcaccaccggttgcggcagtggcagatccaaaatggcccgcagatgcaattcgaactggctaatcgatgcgccgttttgtgtccagtgaccactgttatgaacgcgcggggccaattcattgatcaacagacggtcgccaacgataaaacactccatcgccatcacaccgacataattcagcttatccataatggctgacagcattttttcggcttgctgctgtagtttgctgttgggctgtggtaatgccacgctcatgcgcaaaatgccatcttcatgcagattatgggtcagtggataaaataccgattcaccttggtggctgcgcgcgccgatcaatgagacttcgccggagaagttaatcccctgttcgacaatacactcgccgtaagcatcggggggtaaggtaccctgctcaccagggcgtaaacgccattgaccccggccgtcatagccgccgacccgccgttttacgatggctagctcacccagcgtggcgaacacctcaggccattcactggcactggataacaattgccacggcgcggttgccaaacccaggctatcgagtaactgcttttggggcagacgatctgccagacgtggaaaaatatcgcgattaacaaaagcagtatgggtagctaattcacgggttaaggcggtttccggccaacgttcaatttcagcggtgatcacactgtgctgataaggcaccgcttcaggttcagcatctaagccgacgggataaaccgcaattcccagaggttcacctgcctgccgtagcattcgccctaactggccattacccagtacacaaactggtttcatgcttcttccctcggatcggggttgtccagcacgtcatccgtttggctttgacgccaatgtgctaagcggccggctaattcagtatcgtgtaatgctaagatttgtgcggccagcaacgccgcatttgccgcaccggctttaccgatagcgagcgttcccacaggaatgccgcgtggcatttgcacaattgagtacaggctatcaacgccactcaaggccgcactttgcaccggaacccctaaaaccggcaccagcgttttggcggccagcatccctggcaaatgtgctgcgccaccggcaccggcaatgatcacatgtaagccattggcttcggcctgttcggcaaagctgaacaacctatctggggtgcggtgtgcagagacgacttccacatgaaacggaacattgagcgtggtgagaacgtcggcggcgaactgcatggtggcccaatcactcttggaccccattacgatggcgattttaaccccggctgcataagctgaattgaggttggctcccatgggtgtaaagctcctgtaattgcgcaagcgtcggccagaacgactgactatacatcgtggctggcgaagagggcgtagagcatatcatgagccaaaggcgaggaaaacggttgcgtggcggcttttagtgggatttattggttttttcctgcgggaagttatcgtcttgtcgcgccattgtgatgaggaatacgctgttattcgtcatgagcgggtgattgcttggtaatcaaggttatcgcgtggtaatcgaggttactgtgtggtgatcgaggttactgtgtggtaatcgaggttattgcgtagaaatggatgttaaaacgggaatgtaattagctcgacgttatctgccgtaactttgaccattgaaccttcgacatgccaggcccctagcaccacccgatgtgctgttaccatcggcaattctacgctatggatggctggccggtgcgtatgcccatggatcatccaactgacgtcatggcgcaggaaagcatcaattaccgcttttgaattcacatccataatgcgttctgatttaccgctattattctgctggctcttattccgcatataggccgcaatacgcagacgcaggcgcagagggatccacaaaaataatttttgaatcagcggattatggacctttttacgaaaatgctggtaatcggtatcatccgtacacagagtatcgccatgtaaaataaggattttacggccatataattcaacaacgttctcttccggcagcaagaccatgccgctttcttcagcaaaacgtttaccgagcagaaaatcgcggttcccgtggataaaatagcagggcaccccctgttgttggagtgatttcagcgcagcagcaacctgccgatacagtggctcggggtcgtcatcaccaatccaggattcgaacagatcgcccagaatatataaagcatcagcatgaatagcctcacgctgtataaaatgcagaaaaccggcagtgattgccggttcctgaacgctgagatgcagatctgcaataaaaagcgtgctcattaagccgtcattactcgctaatagtgacgcttttgatgatcacatcttcttttggcacatcttgatgcatgccactgcggcccgtcgcaacatttttgattttatcaactacgtccaaaccgtcggttacttcagcaaatacgcagtaaccccagccatccgggcgctctgaacggaagttcagaaaatcattgtcagcgacgttaatgaagaactgagcggtagccgagtgtggatcattggtacgcgccattgccaacgtgccacgggtatttttcagaccgttgttggcttcgtttttgattggtgcatccgttgttttctggctcatgccgggttcgaaaccgccgccctggatcatgaaaccatcaataacacggtggaaaatagtgttatcatagaaacctttacggcagtaattcaggaaattttcaacggtagccggcgctttatcagcgaaggtattaatgacgatatcgccgtgattagtatgaaacgtgaccataataatgttcctgctagtgtaataggtgtattcacaaatgagtcgtaactctttagacggctcttatatcatatctctgagattgagtcagtactcgttctgctgcctttatgggcgaaaaagtgctgtatcagagactgatttaccgcataatctgatgatatcttgtttatctatgcgtaccgcaaaataaaaccacggaatgtcccaatgctaaagatttttaatacactgagtcgccaaaaagaggaattcaagcctatccatgccggtaaagtgggtatgtatgtatgcgggatcactatttatgacctgtgtcacattgggcatgggcgcacttttgtcgctttcgatgttgtggcgcgttatttgcgttatttaggctactctctgacgtatgtccgcaatgtcactgacgttgacgataagatcattaaacgtgcgattgagaataatgagacttgtgagcaactgacaacgcggatgctggcagagatgcacaaagattttgacgcattaaatcttgagcgccctgatttggagccgcgtgcgactcaccatatcgctgaaataattgagatgaccgagcgcttaattgctcggggccatgcttatgttgcctctaacggcgatgtgatgtttgcggtcgatagcgatcctgattacggtgtgttatcccgacaggatctggatcaactacaggccggtgcacgggttgaagtggctgatgttaaacgtaatccgatggatttcgtgctgtggaaaatgtccaaaccgggtgagccacgctgggaatcaccttgggggccgggccgccctggttggcatattgaatgttcagcaatgaacggcaaacagttaggcgcgcattttgatattcacggcggcggctctgatttgatgtttccgcaccacgagaacgagatcgctcaatctacctgcgcacacgatggcccgtatgtaaattactggatgcactctggtatggtgatgatcgacaaagagaaaatgtcgaagtccctgaataacttcttcactattcgcgatgtgctggcgtattacgatgccgaaaccgtgcgttatttcttgatgtccggtcattatcgtagccagcttaactacagcgaagagaatctgaagcaggcacgcgcttcactggagcgtttatataccgcgctgcgcggtactgatgctaacgctacgccagcagggggcgctgaatttgaagcccgtttccgcacggcaatggatgatgatttcaatacaccagaagcttattcggtgttgtttgacattgcccgcgaagtcaaccgcctgaaaaacgaagatatggccgctgccaatggtctggccgctgagttacgtaaattggctcaggtgctgggcttattagaacaggacccagagctgtttttacaaggcggtgcgcaggctgatgacgacgaagtagcaaaaatcgaagccctgattaagcaacgtaatgatgcccgcagcagcaaaaattgggcgttggcagatgccgcacgtgatcaattgaatgatctgggtattgtgctggaagatggcccgcaaggcacgacatggcgccgcaagtaacgttgtttgatacgcttttaaggttatggaataaggcgggatagggaactgtttagcgagctatatttgttagctgacactatttattagtgggtactatttatccgtggagagtactcattatcaatggagagtactcattatcagtggatagtactaaaaaaattgcggttctggtgtttaccagtaaccgcgatttttttgttcaataggccagcaatgctggctattacaacggctattaggctttaacctgcactttcatgccttgaaactcaacgatctggtctgccagaattttgcagcgcttgcgggtttctaccttcccgtccactttcaccaaaccatcagcgatagctgcttttgctgatgcaccgctgtcattccaaccttgtaactttagtaggtcacatagctcgacatgggggtgtttttccaaatgaaaaatgtccattactgtcctttaactcaattttggctgatgtcgtgatattcctcgcaggcttgcaaggtattttgtatcagtgttgcaacggtcattggcccgacgccacctggaaccggtgtaatccaacccgcacgttcagcagcgacatcaaatgctacatcgccgactactttaccactttccagacggttaatacccacatcaatcacgatagcgcccggtttaatccattctccgggaataaagcccggtttaccgacagcgaccaccagcaggtcggcattctcaatatggtgacgcagattcttagtaaagcgatgggtaaccgtggtggtgcaaccggccagcagcaattcaagactcatcgggcgaccaacaatattggatgcgccgacgaccaccgcgttcaggccgtaagttgggatgtcataacgttctaacagcgtcatgatgccacggggggtacaagcgcgcagttttggcgcacgctggcacaggcggcccacgttatatgggtggaaaccatccacatccttatcagggtgaatacgctccagaactttaacgttatcaatcccgttaggcagtggcagttgtattagaatgccgtcgatttcggtatcttcattcaatgaatcaatcagggccagtagctctgcttcactggtcgccattggcagatcataagagcgtgagacaaagcccacctcttcacaagccttacgcttacttgccacatagatctgtgacgccgggttttcaccgaccaagacaaccgccagaccgggggcacgcttacctgctgccagacgttgttgaaccaccgcagcaacttcgtttcttacctgctgcgcaatcgttttaccatcaataatttttgctgacatcagtggaggggtccatcaattgaaaaaaaacgggaatcggcctattttgtcagaagcgggccgcgctgtcaggcgcataatgacgattaattaacgattaaataaccagttgatgaagcataaggtgaaaacccattgactcgaaagcgactgcccgtataatccaacccgcaactgactaccgtcagcgttctatgctacggtaaatatcaaatgcgcccttagctcagttggatagagcaacggccttctaagccgtaggtcacaggttcgagccctgtagggcgtaccaataaaatcaatgagttaccgcttaaaatacaaaacccgccatttagacgggtcatgtaacgggtcaggtagtgatttagcacttcttgctttgaacccattcctcataagaagcttcaggccaacctaaaaacatcccgctttttgtgcgctctggtttcgggaattcattacgcttggaatacatgcgccagattgttggtctactctttccaactagcagcaacatctcgggccatttaatatatcttgtagccataattagccgtcttgcttgccacgcaaccgaccaaaacgctcttggctggattggttttgatttttaaaaatcaacttgaaaaacgcaaataaagccgaccttgatcaagcaacttctgcattcacccatttctcgcagaacccatcttgagtcgttttccgcttattgctgagatgtaatagagcggcccctcatcacgcattctgcgtaaaactttttcaccgcgaactgtgcgtaagcggcaataaataacccgcatcatcgcacttgcaatgatcttggtctggtctcgatacgagcgcccggaactgggttaataaatacttcactgatatcctttcctccagcaatggctttagcttctgccgtgttttcactagcgctcttaatctcgtcagattttgctgtgtaggtaatttgactagcaacatcgacatactcgtcaggtaatgattccacgttatcgactactaacttctccttccttttaactgaccttactttttgctggaacactaagtagatcacgatcctatatgtctgtctttatttatggggagccatcaggggatttagataatagatttagttgcggctaaaacgtgattgctgtgattacgccaggatggtgtaaagcccaacgtctccagattactcagttcgacattatccgggtttccccaaaccgtatcggcaatttccagtaaagactttctatctgcctgaaaactgatcctttcgccgtgttcgttaattttataatccaacgtatgaccatccacatttagaatggttaactggacgctgtcatctttagatagaccaaacagccaaagcaccatcccgccctcagtctgataagtatcacttattacagcaccgtagtggtcaataatggctttataggtggcagtagacacgcccccgccttgatattcttgtgagacataagctgattcaacttggggtaaacgttggcctaaatccagtggtggggtgaggtcgaaagtcaaaacatagcttgctatatgctcacctgaaagtctctctttgatatgaatatgggccatattgctaccatcatcttcaagtaatgcttgaaagaggtcaccactcggggttttaaattcagggagccataaaaaatggccggaagctaaatcattaacttccggccattttaatattttatcgtgttcagcaattaaattgggtgacatgcagatagagttcctttcttactgaagaacaaatcaaccgccttttgtgagaaatcgatagaggtatcctgcaaatcattccagaaaaaagcttggttaactggacgagactgaccgtttttctcaataacgatttcagatactgggcgaatttgttcataggcagcggctttttcccagccggtacgaacgaccatcaagaggggacgttctttacgattcttcatgcttctcacttcaaagccacccaaaacaccaggtacggtaaaacacccaatacactcggttctgctagcaatagtatgtggcgaatgtgtgatcatactcaggccccaaacagtgagaattaagtggttatagtttaagcgtaaagaggccgaacgtccaccagcgcctactgatatctcacggtgtcagcacgttatctacccgctgaactccagcctgaactaaccaacttgcccatgtgtgtcgaaggtcgtgaaagcggaagttatcgattccagctctctttaatgcaagcctccatgctgtgttaccattaacgcgcactttcctcactgcggctgattttttcccgctgggtaacgtgctttcttttcgatgaacaaacacccattttttgtgattgccgctctggtcccgtaataaccggcatgcggtgtcgttgagagcgacgccaattgcctgatttgctttcctctgagggcgaaatttaacgttatcaaactcacttttcgattattttaaatatcaaggtatcctctcatagcaagggctggtagcattgagtacagttaatttacattttgtaacatccgcttcattgctcgtctgattacgcaccaataccatcatggacactaagccctattttaatcatggatataatggcgtggcttcaacaaattttgagacggatcttcagacaaaatctatcacctccttattcatcgataacatatttcaggatacgtggttactcgctctgaccagtcgcaacaggcccagtgtgactgttaataatgccctttatcaacattgcgaaaatatgatcgaacaggtgcagaaaaaacttcgctcattgcgtattttgggatgaagccgttacgcgagttgcaccccgagccaaaagacaaaatcaacaccactacacagttcctgttttaccccgatgaaaaaccctgggaagccgtcaatccccgtatattgcgcggtgttatcacctccgttcagccatgtgagcgatcagcggatatgaatcactgcaactgagtgaccgcaagaccttcgataataccgaagacaccgacctgttgacgcagccggcggtggcggtactgttccgcagaccggacagaacccgtggcacctggaaacgggtgctaagccgtgatgatcttgatccggacgagccgcgagtcgttgcagtaagaggcaacacattgattttacgttcatcgaaataaagaaccgtcaaattaaaggcaggagccataacgtgacattgtatgacattaaacctcagtttcagaatctgctgcgaccgcttgtcgtcaggctccatgcgcggggagtgaccgcaaaccagattacattgctggcaatgctgacctcggtcctgctgggcgggtggcttatctgttttccgcagcctgtgttatttatttcgctacctgtttttttgttcttccgcatggcgctcaatgccatcgacggcatgttagccagagagttcaatcagcaatcgacgctcggtgccattctcaatgaagtcggcgatattatttccgacgccgcactctatctcgcttttgcttttttgtccggcgtctccccgtggctggttattctggtggtactgctgtcatggctgaccgagttttgtggcgtgattgcccagacgctgacgggaataagaaactaccgtggcccgcttgggaaaagtgatcgtgcttttgtgctgggggcgttaggtctgtttattgcgctttggccgcagtatatcggcgttaccaatatcgtgtttggcgtgacggcattattgttggtctggacctgtattaatcgctgccgtagtgcgatagaggtgaaaaatgcctgattccctgcagacgttgtattactgcctcggtgggattttcagcgttttattgctggcgaccattattattttcgtattaaaaaaatgccgccctcagcgtgactggctggaattacagcagcgcattaatagctggtgggtgattatttgcctgttctcgctggcgatgttgtcgccaaaatggctggcactcactttctttggtttcatcagcttcctgtcattaaaggagtatttgacgcttgcccccacgcgacgttcagacagtgtgccgttgttgtggatgtatgctgccattccactgcaatatatctgggtcgggatgtcgtggtacggaatgtttattatcttcattccaatttatgtctttttattcctgccagcccgtatggttctcgtcggcgatactaaagggttcttacattcagcgtccatcatgcattggggcatgatggccacggtatttgccttaagccacgtcgcttatctgctgacgttacccggtgtggatgctaaagcaggggcgctgctggttattttcctggttgtggcgactgagctgaacgatatttcgcaatatctgtgggggaaatcgctaggcaaaatcaaagtcacgccgaaagtcagcccaaataaaacgcttgccgggttattgggtggcgtgttgacgactatgctgctggcggccatttttggccccttgttgacaccgatggactggctccattctctgggcgcaggcgtcattattggcctgagtggattctgcggcgatgtggtgatgtcggctattaaacgtgattttggcgttaaagactccgggaaattactgccagggcacggcggtattctcgatcgtctggactccctgatttataccgcgccgctgttcttccacttctatcactacttctacgtttaaggcgcgctgatgaaccgtatgttgcgctggatttttacgctgtgcatcgcttatcccgtggtctggatttggctcggtgtccgggttgctggccgcaaaaagttaccaagagacggcccggcgattattgtagcgaaccacaacagccatctggacgtactgacgttattcaccctgttcccgctctcgacgctggtgaaagtgcaacccgttgctgcagcagattattttctgaagaataaagtgattagttggtttgccctgaaggtgattggcattattccggtttatcgcggcgctcatcaggcgaatccattgcaggcctgtgtggatgctctggcggaaaaaaagatcgtgattatttttcccgaaggtacgcggggagagccgggtaaattctcggagataaaatccggtatctggcatttaagtcagcggtgcccggaagtccccattattcctgtctacatgcacggccttgaccgttcgatgggtaaaggccagaaaatccccgtcccgtttttcatcgacatatttatcgacgacccgctgttttacgatgcggagaaagtgacttttaagcaattactcttaaatcgttttgtcgctttacagcaacttgccacaaggaaaacctcatgagtcaggaagtgcgtttatttcaagaaggcatgttcaccgccagcgatgaaacatcgttgtattttcgccactggtctgccacggaaggtaacagcaagaaagttattgtgttgtttcatcgcgggcatgaacactcggggcgtctgcaacatattgtggatgaactgatgatgcccgatacccatttttacgcgtgggatgcgcgtggacacgggcagtcgccaggggctcgtggctacagccccagccttgctcgctcggttttagacgtggatgagtttgtgcgttttgtggcacaggatgcgcaggtcaacctcgacgatatcgtggtgattgcgcaaagcgtgggggccgtgctggtatcaacctgggttcatgactacgcgccgaaaatccgtggcatggtgctggcgtccccggcatttaaggtcaagctgtatgtgccgtttgcccgcctggggctgggattaatgcagcgtatacgtggcctgttttacgtgacttcctacgtgaaagggaaattcctcagccacgaccccgagcgcatcgccagctttgagcaggacaaattaatcacgcgccagatcgccgtcaatattttgctcgatctctacaaaacggctgaacgtattgtttcagactcgacggcgattactctcccgacccagttgcttatttccggcgatgattttgtggtgcatgagaaaccgcaaaaacaattttatgccggtcttcgcagcgcgataaaagagcaacatattctgccgggtttctatcacgacacgctgggtgaaaaagaccgctctattgcttttgataaaatgaaaaactttatcgaccgactctatgcaactgcgccttatgcctttgattatagccatgaagatcgctggagtccgagtgccgatgcgtatcgtgaattgcaggctccaccaaaatcacgctcgctggaagggatgttttatgctgcgctaagtttcggcatgaagaccatcgggcgacagtccaaagggatgcgcctgggttatgaaacaggttttgactccggcagtacgctggattacgtctatcgtaatcagcctgaaggtaatggcattctggggcgtatgattgaccacaactatctgaacagcgttggctggcgtggtattcgcgtgcgtaaagtgaatatccagcagatgattgaacaggccgttgcgaagattcagctcagtcacatgccggtgcgagtggtcgatatcgccgccggacatggccgctatgtgctggatgcactggaaaaacagcagggtatcgaaagtatactgctgcgtgattacagcgatttgaatgtagaaaaaggtcaggcgatgatcgaaaagcgtgggctaagccacgtcgctcagttcagaaaaggcaacgccttcgactatgattcccttgccacgctcgatcctgctccgacgctgggcattgtttccgggctgtatgagctcttcccggataacgacttaatcaaaacgtcgttggccgggctggctgcggctattccaccaggcggcatgctggtatacaccgggcaaccgtggcacccacagttaaaaaccatcgcgtataccttaaccagccatcaaaacgggatcccgtggatgatgcgtgtgcgcagccagaaagagatggacacgctggtggagcaggccggctttgaaaaatgtcatcaggtgattgatgagtttggcattttcaccgtgtcgctggcggtgagaaagcagcatggttgagtccgcactcacgcagaacaaatacagcctctggaaacagggggggtgctggttgttgctgttggggccgctatttttcctcagctacgggcaggtgaatcaatttacagccacaaggtacgatgtagggagcagggtgtttgcctgggaacacgcgatcccctttatgccgtggaccatcgtgccttactggagcattgacctgctatatggtatttcgctttttatttgcacttcaaagcaggaactgacacgccacggctgtcggctgcttgcctcctcacttatcgcctgtgcgggatttttactcttcccgctgaaattcacttttgtacgtccggaaacacaggacatgtttggctggttgtttcaccagctcgaactgtttgatttgccttataaccaggctccgtcattgcatatcattctgacgtggctgctgtggctacgctttcgtcagcatctgaaccgtggggcaaggatggtctctggtgcatggtttttgctgatagccgcttcggtgttgacgacctggcagcaccattttgtcgacgttcttagtggatttattgtggccgtcgttatcagctacgccattccgattgaaggccagtggcgctggaaacgcccgtcacctcacgcgctgcgccttgcggcaaaatatacactcggtggcatcatctttttactggccggggtgctgatcccaggcagctattttttactgtggcctgcgggcgctctactgatggtctctgcgggttatgtgggccttggcacgagcctattccagaaaaacgaacacgggcatttatctctttcggcccgtttattgctctggccttatttaacgggtgcaaggctttcaaagatgtggttttctcgccacattcccaaaacttccgccattttagatggggtatcgctgggctgttttcctgataaatcgctgcaacagaccgcggtgctcgacctgacggccgagtttcatcacagaacccgcgtgcctggtgtctggtatgcttatccgttgatggatttagtggtgccagatgtacaggatattgcgcaggcggtagcaaaactcactgagctacggcagggacatctaacggttgtggtgtgctgcgcactgggtttatcccgcagcgcaacggttgtcgccgcctggcttctggctcagggccacgtttcttgtgtccaggaggctattgaccttatcaaaagccaacgcccgcaggtggtgctgacacctgcccatatccacgcactggaacagtttcagggaacgctatgccagatatcgctctgaccaatcgcattgtgaaaattcatctatcgagctggcgttatttcgccttattaacgctaccaccgctggtgctggcttttaatcttttgtactcgttcgccagcttggtgctgctaatgctgtttttggtgacgcattactattgctggcgtttatggctggatgaacgacttttcaccctgctgaataaagaaagcagtctcgctgagtttgatgaaggaatggcccaattgtggatagccaagtcgggagcgactcgcacgttgacagagcgctggcgtggggttaggggactgttttatcgggctatgttctcacttattgcgctgtggctgacctcattgagttccgtgctttatctgacgttaacgttggttgattaggcgagccataaacgaccatgaactgaagcggtgcatggcacctgcaacccatcttatatctggaactaaaacggagatatttacaaatggatttctatggatcacattaataatgctaaacgcgttttagatgaaaacgccaaagtgctttacggcatctttggtgtcattagctgttctggctattttccacctttacctttcttgaatgaattcttcatggctggcagtgacccatgtgatcaagatgaaagaatggatagttggtgtccatttacactcacgagttctgaatatgaggaggtaaaggcctggtggcttgtctctcgtccaggtactgttgagtccgcacttggcagcgagtgctgggatgattggattcaagagatcctggagctataaatacccggtaggtatcaatacggattggcgccagatttggtttggctaacaaatcttttcatttgtgccacgggtaccccgttgtgcggctaaacgtaacgcaggtctatgtgtgcatatatgtgtaggatatatgtgtaattgcagaaaacgtccaacttgtgtggctgaaatcgaataccgggagcagggcttcccgtttttgggggtctaattggggggctgcgttttttgaacagaggaaaaccagtaatagcaaggcttgtaagggtgttattcgaatcctgtaggggaaatagccaatgctaaaagaaaacttcaatgaactgcagagctttcttgttgttgctagagagagaagttttaccaaagcagcaggtaagctgggggtttctcagtcggcactcagccacgcaattaagggactggaagaaagattaaacctacgccttctgacccgaacaacgcgaagtgtcgctcccacagaagctggtgagcgaattattgcctgcctggaacctcgtctggcagatcttgaacaagagttggaaacccttctccaactgaacggtactgtatcaggcaatatccggctctctgcgggagagcacgcagcacgtagcttgttgtggccaaagttaaaaccatttctcagaaaatacccggaaatcaatgtcgaactggtggttgataatggtttcgtcaatatcgtagatggccgcttcgatgccggcgttcgtcttggcgagagtgtcgataaggacatgattgccgtaaagatcgggccggaaatgcgtatggccgtcgtcggctcgccagaatactttgtggcaaacgccattcccgtcacgccacatgaattacagcatcatcgctgcattaatatgcggctgcccaccgccggaggtttgtatcactgggagtttgagaaagaaggcaagccgctgcgtgtgaaagttgaaggccagttgacgctgaacatcctgccagaaaggatagacgcggcgcagtcaggatttggccttgcttgcgtgccagaggattcgattcaggcattcttaagatccgggaaacttattcaggtgctggaagcgtggtgtccatctttccctggttattacctttactacccaagtagaaaacagcacccacctgtttttgcgcttatgatagatgcactgcgttattcggattaactggcttacggattatcgtaagccagatgaaatttgagcgactacaattaagtattaacgacccactcgagcctgcatggccgcaggataacgctctcccacaattttcaccgttgcaagtgcctgagtaatattccagatatcatcctgagaaagggtaatatctgcagcccccaggttctcctccagcctatgcagttttgtggttccggggattggcacaatccaaggtttttgtgccaacaaccatgccagagcaatttgtgctgacgtcacgcctttttctgcggcaagaatacccagcaaggccacgagcctttcattggcttcaagagcctctgcggcaaaacgtggcactttgcttcggaagtcatcctcaccgaatgtcgctccggccttgatggccccggtcaggaagcctttacctaacgggctgaacggcacaaagccaatacccagttcctccagcagcggcaggatctcctgttcaggttcacgccaccacattgagtattcgctctgcagcgcggcaaccggctgtatagcatgcgcacgacgaatagtttgtgcgccggcttcggaaagcccgaaatgtttgaccttgccttcagcaatcaagtctttcacggtacccgcaacgtcttcaatgggaacatcagggtcgacgcggtgttgatacaacaggtcaatcacgtcagttttgagtcgacgcagtgatccttccaccgcttcgcggatatgctctgggcggctgtttaaaatctgctgtttattgtcttcaccgaaggtaaaaccaaatttggtggcaataacgacttggtcgcgaaagggttttaaggcttcgccgacaacctcttcattcagataaggaccatacacttcggcggtatcgaaaaatgtcacaccacgctcaacggccgcgcggatcagttcgacggcctgacgagtatctgttgctgggccgtagccatagctcagccccatacagcccagacccagtgccgatacttcaagtccggatttaccgagataacgtttttgcatcaataatctcctcttctatagcggcttagacatcaagtttacggccagtcagccattccaccattgccgggtcgcgatgtgagaagaaggcgctcgttgcggtatcaagagccgctatctgcagcatgtcttcagcactgagctcgaagtccagaatgttaatattctcttccattcgcccttttcgcactgattttgccagcgagacaatgccgcgctggaaaatccagcgtaatacaacctgtcccacgcttttgccatatttttcgccgatagcggttaataccggattctggaagagaccgtttcttccttccgcaaacggtgcccatgcttctggctgaatacctcggctttgcatccatggcacagcgtggagttgttggttgaacggattaacttcaatttggtttacggctggaatgatcttattaaatgccatgagatcagccagtctgtccggatgaaagttactgacgccaatggcacggattttgcccgcctggtgtaattcttccattgcacgccatgcgccatgaacgtcgccatagggttggtgaatcaggtacagatcgacataatccagttgtaggcgattcagtgagcgttcaaactgcgctttcgcaccttcataagaggtatcctgcaaccacaatttagtcgtgataaacagttcatctcgtgcaataccactcagcttaagcgcattccctacttgcgtttcattctggtaggaagcggcggtgtctatgaggcgatagcctgtttcaatcgcatcgataactgcgcgctcgcattccgcggtattagtcatctggaagacaccaaagcccagcagaggcattgcaataccgttgttcagttttactgtttgcatgacgttatccttcaactgttgtgtaggaaaagcatagcgcaaagtaatttatttgattagaaggggtaattaactagggtttattagtcatattcatgaatgcttaaaaccgttcatcgtggtcgacccactctgggtaaccgaataggcataatgccgtaaagacagcggggtgatcgatgagatcccaatggctgacaaaaataccccgatgactgaccaagatattgatacggtgtatggcgtcacaatctttactggtggagatcgttcatactctacggcagataatctgtataaaaggataaaaaaatgatggaacaacaattaaatggtgtaggcagcaccctgtgtttctcacacaaaaacgggaggccaatgttcggcaggcacccctgccaaatagcccggtttgtcgcgaccaatcgctggatcaacggctttatcgcacggtgatgttaaggatagaaaaatgaaaacatggatagcgcgtcttttaggtaaagatatttcaattgattttccagccccttgggcggccgatagcacggcaatttatcgttggttggcgacttggccggatagcgaagggcctctgcccgcagaggcagaaaccttgccggatgagccttcggccattgagggtaaaatccggtggtcggctggagcgcttgatggtgtctttgggcaccatgttgcagaggctgatgatgaaactccggttgaggccatcatggcggcactgagaagtgtgttgcataagccgcagcagcaggatatcgagcaactgtatcgtttgttgtgccatgcgtcgccgttaaattatctcgatgtcttgctccctgcggttgcgcaagatccgcaactgcccgccaataaattgcaggcgttggcagaatggctggcaaccgaaagcccagatcgcaacgccgttaaggtagccatagcgctattgggctttttcccaacgcagaaaagttgtcagatactcagtacattgggggcacatgacgagtttacgctttatgcggcagtggcactgagatccatactaccagaggatgaatatgaacgtgcttggcttgcgatggcgaagcgtgctggtggctggggaagagtgcagttgatcgagcgtttgcccgaatttttgagcaaacagagtcgcgattggttgttgcgtgagggttaccgtaacgcggtgatgtatgaatacactgcctggcattgtgcgactcacgggcaattacttcaggcaatgcaacaacttaagacaatgcaaaaacagcccgatgcgccgctattactgggggctgcagagattttgcaggcgttaattaacggcggcccagcgcaaaatatgcatgattacgccgaaggtgcgctggcttgcgaatactatctgcgctgtttgcaggcggctcccccggcagaaatacagcattatctggcggcgagtgagattgcgcgttttgcacaggaacaaaatagcgaagaggagggcgtatgggatcaggcacagtgcaacaacttggtcgaattggccaatgttgtcatggcactgccggaatggtcgggtatcatcgccaataacttgcagggaagtgatacgtatctttttaacctggccgtttccgctagccggttacgccagcaggatccgtgggagagtattttcgcgcggcagttggcggatgcagcagataacaattggtaccagttaatgcagactgcccagcctgagcatatcgccagagtgatatcgctggctgaacagcagttggatttagaggctatcgcttccgggccaggaatggctatggggctcgggttggagtaccagcagcatcaggcattggattttgtactgcaggatctgaaaaaattcccaggaatgggctggtcattgttggcggtggggttacgtagtgagaggatccgtgaccggtctatggcgctaaacgcattggacgtttggcctcaggatgattggtcgcctgatatgtcacaggcgttggcggatagtttatgtcatgagcccgatgaacagatgcgggagcgtttgcataagttatgtgtcaatcttgggatcaccacgggctgacccagatagtttttgaaaaacgccctggcagagatggaaaagcagcagggcgttagcaaagcattgaaagctcagtcattacaatgaattgatttcttgtaagatttcctgcttcagtttctgccttttcgcctcatctttagcgaattcaggtttcagtttcagggcatcttccagtttatcacccagtgttgggttgccataaatccaagcgttagtttgctcatcaccgataaaacgggcgacgatcgtggccgctttttcatacgtctggatgtcaatccagggggtatcaaacgagaaagctggggtcgaggatttcacaatcagaggtgtttctgcatggatatctcttgacgaacgaccaatgcgcagtgtgaagagccccggttcaagcacccagttgtttttatcctcatcgtaataagagaacgcgcgtttatccagtttgaaggccacgcgtttttcctctcccgccgacaggctgactttttcaaatgctttcagttcctgttctggccgatcaaggcgtgaggcattgtcatgaacataaagctgcacaacctcttttgtatcgataccggaggtattacgtacagggatactgacctcaatactattctctgtatcgatgttgaataccggtttttctgggctgattttcccataattcactgtggaataagaaaggccataaccgaatggatacatcggggcaatgcgcttggtatcaaagtagcgatagctgacatagatcccttcaccatagataactgttttagcgttaccagggtagttaccaaagcttggtgaatcttcgagccgtttcgggaaggttagcggcaatttacccgaaggatttaccttaccaagcagaatatcggcaaccgcatttcctgcctgttcaccgggttgccaggtgagaagaatggcatcagcatattgttcccaagaggccatttctatcggcgaaccaatattgagcagaaccaccacctttttattctgctgatggaacgctgaggccaccttttgaatcattgccacttcagcggtatgcatcgccatagagtagcgatcagccccctctgttgaactgcggccgatcgaaatcagggcgatatcactctgttgtgctgctttagtgataacaggctggttaaccggttcatccaacgtttgatccccaatctgcctgatgagcgctatccctgcgtttttcaggccctgtggcagtgttaccaagcgtttgggatcaatattgacctccgcactcccccctccggttacaaagaaattgtcaatattttgaccgaaagcggcaacgcggaaggtggctttcattgggagggtttgtgcatcattttttagtaataccattgaatctgctgcaatttgtcgcgccaatgctgaatgatcgacaggttctggcatcacggccgcgtccccgtttttgaaccggtgagttttgatcacgacattgaggatattgcgaatattttcgtctatctggtcttgggttagctcaccagattttagcgccgctaacaccacgtctttaggatcggtattgggtgtcaggaatagtgagtcgtctggtgtgcgcccacccggcatattgagatcgttaccccctttcaatgcgctgaccggatcggccacaccataccaatctgacatgacaaagccatcgaacttccattgttggcgcaagacatcctttaataaccagggattttgcgaggatggtgtcccattaattgatggataagagctcattactgcccaaggttgcgccttttccatggcatattcgaaaccggggaaatagatttcatgtagcgcacggtctgaaataatctcgttgactatctgacggcgtgtttcctgattgttggcggcaaaatgtttgagcactgcgcccacgccctcggtctgcataccgtcaatataactggccgtcatgatggcattgagtaaggggtcttctgtgaaatattcgaaattacgcccattcaatgggtggcgctgaatattaatcgcaggaccgagaattaaatccacaccatatcgtttggcttcatcaccaatggctccgccgacacgcttaataatggcggggtcccaggtcgccgccattgccaccgacactgggaaccctgtggcaaagcgcttctcaccgccggtgggtcctgcccccagcctgacccctaccggcccatcggcaaaaacaatctgtggtatccccaatcttggtatcgccagggttgaaccggcagcaccggcaactttttctgcgttattcatacccgtgccggaaacaaaggctgctttttcttccagtgtcattgccgcgatgacagagggaatagactcagcctcttttaactgagggggggcccaaacgggagctgaaaggaaagtaaacgctgtgaaaaaacctgttttattcagattcatatatcatccattgtactaatgaaagtgaagtgatttatgctcacataggcccgccagtggtggtatacccatcaatacggggtagaccatccgtgaatataagcgcgataacgggtcggcatggggccagacggttcttttttattgtttaagaattacttattctctatgcgctgcaaatcggcatccagtaagtgggtcagcaacgccgaaccatccttagcaacacgaaactcaccgtagcgtgcattgacgtaatcttccgcatgtccttcctggaaaaaatacgcatccgttcctatctgaatagacctgcccttaaagcggtattgcaaataatgttgattatctgccagaggctcgccctgatcaattctggccgcggtggcccgctggcgatcgtcgagttcaacaattagacgccttttggactcaggacaaggcagtgaaggctcttctctgcatttttcttgttctgcatagaattgttcattgaatggcgctacaagggcataactcagcgccatataatcaccctgcatcaatgatcggggatccaccggggccagttccagaataatgatgtcacctttagccaacaaatgttgcttctgataaatagagatattcaccacgatcagggcaacgataatgaccgcgatgctgagccattttctcttaagcatgttgattgacctccccagcagagagtactcgattcaatacggcggccaaaaccagcagcaagacaccacacccgattaataacaaggatttatacaacaagctgaatccgaggaagtaataccagctactggtgtaaaccgcgagaaaacaggctgcaacccccagtaaccattgattcccttgataacgggcaatcaataacagtgccaaaccaaaacccattcccggtgcaaaataggctgcaagggaggttacgaccgccgctatcaaccagagtggcttgagcttactgcgatgcaaaacccattgaattagcgtaaacagcaagaaagcggcagggatcccgtagctcaaactctgttccaaataaagcccccgatctgacatccagtagaattcatggatattccccatctgaatgctgtgcaggcaaaccaccagtatgcccccgatcccgccatacattaacggatgaatcagtggtgcattgatggtcgccagcaatttagtttcattgcagatcagccaaagaatcaacatgacaatgacggtgactatcaggattggaatgaagaaaaagagctgttggttatcgggtgccaagtgccatatcagagcgtagcttgtcgtaacaatactcatgaataccaacgtgcccgtcgccagaaagcgatacatatcattgtggaataccacaatcagaaccgccaaaacaggaatgaaccacagactttgcatcagcatcgatctgctgcttgaatcctggattaatattattccgctatataacccgatcgaggatgctattgcccataccaaaccaatctgctgtatccccatacccggtcgggtgagcaagaacgcggcaaaggcaccgcctatcagtgaaacaacaataattgttccagcattgagattgtcaaacatcccactgacaaatcccagcaatatcaacagagctaacaggattaatgccgcgatccacccgccgaacgcaaaagcggtacgaatataccaaggcagagttaacttgccttgttcagcaagcaacaccgctttttggtctgcgttgagcaacgaatgctgttcgagattaactaacagttcgtcgtaggctgatcgggataactccacggcttgatttggatacatctttcggcgccagtggagtaacaatttgccccctgcgccaagcaatagggcgattaatatcccaatcaggaacagggagccaacatttctataccaaccccaacccgccgaggtaaggatagcggcagttcccaccgctaataagctgcaaacacccagtgtcagcatgcataaatcgggttggcgatagcgataccaccagtagccaccggccataaccgctacccagcaaagtagtaaaacgtagccaggctgttggaagtgaaagtaagtgagttcactgattattggggttgtcagtgacagtaaaaaataggctgccatgagcctcggaaaccagcgatttaccgttttatcgggggattgggttttgctgaatctttgtgtcacttcccaggccaaaagacataatccctgaaaaagcaaataaccatacgtgaacaaggtgttgagataaaaaatgttgtcgaacagtgagaaagagaccgtaaacggcgatgagtaactgaagaaaaagagattcaggccaatattggtcaccagccaggttaaaaaccataatcccccctgcctgctgagcaacgctaaagggagaagaattagtgcccaagcgcggaataactcccagctatcggccccggtttggtaaatctgcccgaagacggcaaacagcgcaccaaagaggaaccctgcggccaataatgccgtgcgactgacggcatcataccagcgccaccagatgagaatggccaaggccacgatcagcaattcgatgataccgaactttgccattgcgggcattgctgcccagttccacgcaaagaaaaagatgacgccacagatggccgcgagggatccggccagtagcagcgttctactgagaaacaaacgccaagcctgacgtccgggccggacaccgcaataacgtaatatctgttcaaaggccgcaggtgcaagaagatgcattggcaagagtgactgcaactggcggcagagttgcgctgctgcatgtgaaggcatccaagacgcgggtttcggttcagccatggtttacatccttgtttctgaaagcgaaagggatatcaaatgccgtcttgttgccgataggctctgacggcgacaagatggcgagtcatctctggtttctttataaatgatgaaaagtaataagtaatgaacacgttcaatataaacggtgaatgcgtttaatataaacgataagtgcatttaatataagcgatgaaagcgttcaatataagcaatgagtagagggaaggcattgggcagaggtatggcgaaggccgctaaaatggcacgctattggtttgaaacgcccggtcgtattaccccgatcaagcttcgcaatgtaccttggttaagcttcgcaatgtaccttggttaaggtatagtccgctttttacggaggaaccatgctgactaactcatccattcgtctgaacaaatacattagcgagagcggcatctgttctcgccgcgatggcgatcgctacattgaacagggcaatgtttttattaacggtaagcgagccaccgttggcgatcaggtatttgccggagatgtcgtgaaagttaacggtcagattattgagccgcgtgatgaagaagacttggtgtttatcgcgctgaataagcccgccggtatcatcaccacgatggaagagggtgagcgggataacatcagtgattttgttaaccacagcaagcgtgtctttcctatcgggcggttggataaggattcccaagggctgatttttctgactaatcacggcgatctggttaacaagatcctccgcgccggaaataatcacgagaaagagtacgtggtcaccgttaataaaccggtgaccgatgagtttattcaaggcatgagcgcgggtgtaccgatcttgggaacggtgaccaaaaagtgcaaagtgcagaaagaagcccccttggtgtttcgtatcacgctggtgcaggggcttaaccgccagattcgccgcatgtgtaaacactttggttatgaagtcactaaacttgaacgcacgcgcatcatgaacatcagcttgaaagggctgccactgggcgagtggcgagacttgaccgacgatgaactactcacgctatttaagctgattgaaaactcctcttccgaagaaaaaacggtaaaaaaagcgccacctaagcctgtagccgctaaaagaccgggtattcaggggcagaaaaaagccgaaaaatccgacgacaacaccgcttcccgcaagcgctttacccagcctgggcgtaagaagaaagggcgctaatccagagttaaacctgctggtggcttattattgcgtgttggtggcttattattgaaaagtgataagcccattcaccattcaccgttcaccgttcaccgttcaccgttcaccattcatttttacataactgaacgcacagccttgaccaatgacaaggcgggtcgggggttagccactttataatcaggttcatttattttctctctggtgtgaaagtatggcttatcaactaaacctcaactggcccgaatttttagaaaaatattggcaaaaacaacctgttgtattaaagaatgccttcccaaacttcatcgatcctattacgccggacgaactggctggtttggcgatggaagtggaggtcgatagccgtttggtcagtcatactaatggccggtggcaggccagtaacgggccgtttgagcactttgataacctgggtgaaaccggttggtcgctgctggcacaggcggttaaccactggcatgccccgtcagccgaactggtccgtccgtttcgcgtgctaccggattggcgcttagacgatctgatgatctctttttccgtaccgggcggtggcgtcgggccgcatattgatcaatacgatgtattcatcattcaggggatgggccgccgccgctggcgtgttggtgataaactgccgttgaagcagttttgtccgcatccggcgctgctgcacgtagagccttttacccccatcattgatgaagatttagcgccgggcgacattttatatattccgccgggcttcccgcatgacggtatcactcacgaaacggcgttcaactactccgtcggttttcgtgggccaaatggccgggatttaatcagcagcttcgctgactatgtgctggaaaacgatctcggtggcgagcactacagcgatcctgatttaacgtgtcgggagcatccggggcgggttgaagatcatgagttggagcgcctgcgcgggatgatgctcagcatgattaatcagccggaagattttaaacagtggtttggccgcttcgtgacgacaccacgccatgaactggatatcgcccccgcacagccgccctatgatcaggatgagattgttgatgccctgatggagggcgctgtattgacgcgcttaggtgggttgcgagttctgcgtgttggcgacaacgttttcattaacagcgaacggttggaaatggccaatgctgaagccgctgatgctctgtgccgttacaccattattggcaaaaaagagttgggcgaggcactacaggattcggctttcgtcacggaattaaccgaattgattaatcagggctattggttcttcaacgaataatagcgctatataccctaaataatgggtgacaggttgtgtaatccctgcattaattcatcggcatgctcaaagctgatcgctttcggtacatcgaccagcgtctcaaatatagctttttctgggcaagaaaatgtcactggcggtagctcctcgcgccaggtttcttcgttaaggaatctgggatcatccattgtcattttcggccacaggcgatgggtaccatgccatttgaatttagcgttaagtggtactctattcagccatgttggcagagccgcctctgaccagagatgaatatgctgctcagctgtcctaatccggccaactctaaagctgtcaggccaccgacatgtataggttgctcagacatcctttgtagtgacgcaacaacgccttgccaactgactctggcctctagcaggcaatacaccccggcggtaagcggcagtagggttgagctgcgcacggcattgtccaaaaagtgcagactcaacccttggtcaagtaaccactgtttagtcgctaccatctccaatggcaggagtttgcgaagttgttgccgtgcgtctgtgtttagcatggtttaataaatctcctttatacggtgattactgccgtatttactgaaattatcaaactattgatgaaggttggtttgtaaaagcaagtatatacgtcaataaatgcgaataataggaatgcaacacgtaaaagaccttccccaatatttccgggatataagtgtaaaataaattcctcgcgctatgctgatacgttcgccatttgtaatgcatttttaaatttgtagggaatacaggaaatagcatcgattattgtggaaattatcttgctgactgagcatttttttttaatttaataaaatggagtgaaatagaaaaaataacccctcagaagaggggctgaggttattgacaaagtgcccacgacggagagaacaggcagatcgtaaagacgccgtaaatacatccatgtaggctcgagccgcgccatccttggcgcggacgctttactcctctgcctatcctcaccgttcaagagtgagtcatcggggtttgtcagcagtctgaacccctcagaagaggggctgaaacaattagaaccgaaggcggaaaccgatattggcagttaccggtgtttcaatttttgaaccattgagataatccacttcagcaaaaatggcggtgttattggctaccgtcgcatttatgcctacgccatatttaccgacattaccggagaaatcattatcgaaaccaatgttgttaatcgctacagcattacttttggtaaattcacgggtaatagccagtttaatataaggctttatcgtcatttggttaatgctgtaagaggcggcgagtaccgtgcctaactcgccttgcacgctatcggctttcgccacttccgctaccataccgttactgagagtataatctgcgctaccaatacgtgaataactcacctttccatagggttcgagcaccagattggcataaacaggccattgataaccactttctactgaggtggtaagagcattctggttatattcgccacgggtttcctgtgtattcatcttattattaaagcggttagcttttagcaccgtatcaacataaaatccgctttgatccaaataggtcagatagaggccaccaccgtaactgcgaatatcaccattagcgccgtgggtggatttgacatcagatgaactgtaggaggtaaatgctccgatcaacatattaccccggtttaatccaagttgtttatcggccccaatttccatgccacttaaggtattcttgaaagcgatatttttattatcagacaaccggctgtcatccgtaagataacgcgcccaaacgccaacagtcccttccgcatctgccttcaactcgccttggcgctgacgcaaggtactcaattccgcattcaggatatgccgcggtgccgctgccatattcagcacaccttgtgctgcggaactgagcattggagcggttacgttcggtgttgtacctggcagttcttctgtgctagttgccagataccagtcagtgctgccattgctttcctgactatatagcccgtattggtaaacacctaaatccaccactccgcctgtattgagtaaacggaactgagcatcaccacgattaatatgtaccagtgccaggttgtcggcagattgcggctctttaccgctgtcctgaacggtaataccaaattggccggtcgcctgctgtgagaccgtaatgaaatccccggtattgctggcaagctgggttgtcatcgcaaaattaccctgaccagacaaattttctatctccagccggttaaattgcccaccagcagaataggccattaaattgatatcccccccttgcaaagtcacattattgattcgggtaaccagcaccggccctaaaacgtcagagaggggaagcggcacgatactcgtgcccttccaggaagggccgatttcgaccagacccgcgacgttgagattctcaatcataacattggcaggcagtgcggggttatgggtggtcacatcggaggtgtatggatcgttgttggtaacaaaaagttctgcgccagccgctatattgaggtagcctttagactggctattaagtcccagagtcatatggccgccatcattaatttggctatctattacggtacccgccgttttggtgtcaagcagcccgccttgattaacaatggtacccgtcgccagagcaccggtaatctgtaaccagcctttatcacccacggtagtattatttgccgtaccagcactgctcccgttggtgacagtaattgcggcattgtcactaaccagcccattattaatgactccgccgtcgcgcacattctgtataccatgaatgacgacttcatcgttgacagttattcccaccacattcggtgtaaaagccaatacctgaacaggtaatgtaactaaagatagactgatagcaccggccaataatgttttgtccataaaacctcaaaaatattaaatgtaatgagatgatgctatatcactcattgtaaaaagagacacaccgcccttgggacggtttgaacgttatgtttatcagtagcaatatacataggaggggaagtatatagatactcaacagcactgagtttcaaggattattatcccagacaaaagaattttactttatattctagcaatgtgaaagtagcacaattcagtttgaaatcataatagggccaattttgttttttatggaggacgacaaagaatgaaatcattcagttcatgaaagaatattcttaattaattttgagactattcttgtcataattatattttatcgaagcaagtggcgtaatacagagtggggaggctaagtgttgccacatctggattaggtcgcttcgggttaatgtctgcggttggttgatattctgcccatctataccctaaataattcgagttacaggaaggtggtaagggatctcatccctatgcgcttctttattttaacgtcaacgaccagtaagtgattcgggttgttgagcgtagccaacgcacatgcagtttggcgggtataactggcattaatacgctagccactagagtaattggaatgcaacacgtaaacgtcctcataaacataacggcagatttttcgacatttgccttgcgtctgtaaacaacacgtataaaataattacgtacatctgtttttgcaattgtgtgaatcatgtcacattgagaactaaaatgataattactcatgtactaaaagtcatttactataagggagtttattcatatggaaaaagaaaaaaagacgctattcggccacaaaacccccgcaatgatgcagctgtcagagcaacttgaaagttctttacataatagcccattagttccagaggaaaaactagcattaataatgaaactatgtgttttattatttagagaaaataagacggatgctgctgaaatgaaagtctcagatggtcgcatactaaaactcacacttgaaaaaacatcatctgtattgcattaatgttcgatatttttctttcttaataagaatggggtgacatgatgaaaaataataaaaatataaataaagatgaattttcagataaattggctcagcaaatcaaagaaatgataaataacagccagttggattcggtggagatattatcagtagttatggagagtattttttcgttgttttctgaaacagaaggtcaccttgcagagatgaaattcattgattctgctggagaggattatcggtttatactcaggcttgaagtgccgccaattttggaacgacagcactaacctctattacataaggaattgtcatgtctaatttgatttatgcaagtgttaatggtaaaaaacaaggtttaatatctgccggatgctcgtcactcaactctattggtaatcggtgccaggcaggtcatgaagatcaaatacaggtattaagtttaaatcatagtataagccgccaacagaatgtagctcatcaccctgttcattttgttaagcctatagataagtcatctccattgctaggcgtggcaatatctgaaaatgaacgaatagatgttgtcttttatttttatagagtaaattctgctgggcagttggaactttattatgaagttaaactgacagatgcgagtattgtagatatcaccagtgtttatccacactcaatagataataatgaaatgataccgtatgaaaaaattcaattaaaatataaatccatagcgtgggatcacaaaagtgcgggtacttctggttacagtgtatgggaagatagggtttactagtttctgatatcaagcacactttttcaagtgtgcttgaacatatttatattcttcaattggcttgtttaccaaaattatttttgggagaagtaagaggcggttaactatggacatagctttatatcttttacgtattcattaggggacatccaagatgatcttgagcatagcttataaccatattcggtgaggctataaccgatatatacagatgaaaaaaaactaatcacaacacccagcatggctaacatagcgaatgtattagccagtttattattcacctttgcaggtttgttttttattgcacaataaaatgcaagatatgaaaaataaaacaatacaggagcaccaaatatcatcactccaactttccatgagaagataataacatcacttaatttaaaaaaatcccagtatccatttaaagaaaaccagctaacccaacatgaaagaaaaagaagaaagactgcaaatgcaccaaacaatggcctatttatcttaaccacgactgaacctcccccaagcgctaaataattggtctggatgataaggaatattgtgtactctatgtgtttttatttttttttcgcttattctatattcgttatctaacaagaataagattacgagaaccccgatggaaaatacgatggaataccggtagccgtagcgcacaatggagtcagcgccaaggcgcaatatagtgctcggaaatatataacagcattagtggttaactatggacatagctttatatcttttacgtattcattaggggacatccaagatgatcttgggcatgatttataactatattcggtgaggctataactgatatatgctgatgaaaataaactaattatagatcccaatatagctaaaatagccaatgcattagccagtttgttattcattattgcaggtttattttttattgcagaaaaaaatgccaagtatgaaaaatagaacaataaagggactgcaaatattacaaacccaaccttccatgaaaagataataacatcgcttaatttaaagaaagctaaatatccacttaaagaaaaccagcacccccaagatgaaagaaagaaaagcaagattgcaaatgcaccaactaatggcctgtttattttaaccacggctgagtcgcccccaagcgttaaagaattgatcagcatgatacggtgaattttgtactctatgcgattttatattttttattattgtttcacttattttatattcgttatctaaccagtataaaattaagcttgcgagaactccgatggtaaaaatgccaatagcaatagcaagaacactacctccggcgaccataaaaccggtagctaacgcctttgccccccaagcaaccccaatagatactcctagttttgcagcatcaagagttaaattaacaaaaaaatcagctaacccatattcatctttcaacaacaattcaacggaacgataagcagcagaaaatacaatgcagaatcttgcgcctctaacgatcccattttcaatactttgagttcctatgcctatatctaatatttttgggttatcaattaagtatcttgttgcatctaaatactttcttattccagcatatccagataatttaatatatgaactgccatttttccccacatattcagttgcagttacaccaaacccccttatttcaaagactattctactcacagacaatgactcaacgagactgccaaaaaaaaccgatgtgggatcggtacaggaaaaaatagcatccttccacgattggtgagggttgggattacataatgtttttaaaaaatactccccttcctctattgttaataatgcatgcatattttcatcactcatttcattgagttgtttatgtagtttttgatatctgatatctgcatgttgctttttaaaatcaagatgatcttctaatcgataatcatcatcaacaaaagtttttaacactgagtcatacttcataattattaactccctgtatataatttaagttaagtcaacgcattatagggagttgtgcaccagaatcccataattttctgtcaaaaagctaaaatctgctttccaacggaattccaaactgaccaatcaactaaccagcaggagagttgttggtgtcatggcctacaagactggagtaattatttaaatgaagaaaaacttcattacgaagaagatgaccagagctgaatgggtatgagccattcaacttatttttagaattaaattttaattatttgctttatttcagcccactgtgctttttcctgcttcatccccagtttccttaggttggattaagttttttccatcgcagacgaaattagcgcacccagttacaccccgattcaattctgcacatggtgggaaaacacctaatgcagtgttaaaaaccaaactgagtatttacgatcaaatgtcaatcgaggccctgagtgatacagttaaataatgataaggcgatggctgtcgtgacaataatagagacactcgcagccattaaagctaatcctataagcagggataccatacaaatcccattaagatctctataacctaaaaatatcctgttttgggatgtttttcagagcatgggataattacccgaacacatcagatggaggggtaaacgttatggataaacaagattggcatccggcagatattttggcggggttgaaaaaacggggtacgacgatggcggctctttccagaaaatcggggctggcctcttcaacgctggcgaatacgctattgcgcccttggccgaaaggcgaaagattgattgcagaggtgctggagttacaccctgcggagatttggccgtcacgttacctaaaacctaaaaaatcacccgcagagtcagttaatccaggctgattccgtttattgaaaaggatcataaaaacgcgagattgctgccccacaatggtgtgacctgtggggcttttttgatccccttcatatgtgacgcggcaagaggaaccgccctccggccgtttgctggttactcatctcgttgaccaatatcaatatattgccccgtagaagcacagcagacgctctaaggatggaaaccgtaaggtgtgccattaatccactttctcaacacgaattagcctactatcagcgcggccatgatcatcaattgctcgaatgcggtattgaccgctgcgggtcggatgccaatcgatggattttttactggtgctgctgcctagatagatatcgtcaacaaaccagtaagtggtggtgctatccgcatcaagagtggcgctgaatacaatctgatcacggccctgttgtgattggcgcagggtgtaggtggtattgcgcagcggtgaggtgatacgtggtgcattacccgatgcgagagtattcccttctttacagtgagagcggtcaggtggttggcgtttcggcaagcccgcttgagcaaatacattggccagatccgatggccagaactcaaaaacttcagtacgggtctggctgcggtcataaggtagacaagcggcctgaccactatttatatcaatcacgacggggcgatagaccgtatcgactttgatcggcgatttccccggaataaaccaggttttaccttgctgctgacaccaaggcgtgggcaagttgccgctggccagacagatagccacccgttttaactgtggcggccaaggatgtttaggctcgcgcagcgctgggtagttagcctgaatactgtcaataatattaaagaataacggtgcggcggcatcggcaccgacaaaggcgctgttgcccttacccgcaaagttgccttcccagacgattaacacataagggccaaaaatccctgcgctccaggcatctctgaatccccaagaggtcccggttttccagtagaccggtagcgaggtggggctttgtgccaaggtatcaccggggcggcggtgctgacgcaacatatcaagcgtgatgaaactggccgcctcgcttaacagacgaatggagggcagcgttttatctgtttgtaccatttgtatggggtgcagtgtgccgcgattcgccaacatggcatagagccgcgccagctcctgtagggtaatttcaccgccccccagcaccagtgataaaccgtaatggttttcactggccatattggtaacaccggataaacgtaaaaattggtatagcgttggttgtcttaaacgggatgcgacatacaccgcaggaatgtttcggctgaaattcaaggcgtccgtggcggtcactggccccagaaaacggtggtcaaaattctctggcgcataggccccgaaagaagagggcacatctttcaggatggtcatcggatgcagtatcccctgttctagccctagagcataaataaagggtttcagtgtcgaaccgggggagcgtttggcattggtgccgttaacttgcccctgaatttctcggtcataataatttgccgaccccaccagcgcccgaacgcccatatcccgtgtatccagcaataataccgccgcattatggatgccccggctgttattacggcggataaaggcctcgacctgtttttctaccagttgttgcagattggcatccagtgtggtgtcaacctgactctgggtattcgccagttgctgattttgccgccggatctgttcaataaaatgcggcgcgatatagggcattttttcgggttgacgcaggctgagcggtaactggaatagtgccatttggctgctatcggtggggtacgtttgttgccagcgaacgaatagccggttacgggcttgggtcagggcgctccccagcacaccggtggtgggatcaatgcggtaactgggcgattggggcaataccgccaatgtcagggcttctggcagcgtcagttgctggggttttttatcaaaataaatcaggctggcagcggcaatactttcgatattacggccataaggggcgtaattcaggtaagcctctaaaatatcgtgcttggaatagctcagttccagttggatagctcgggcgatttgtcgcaatttacctgttggcgaacgggtattgagatgccagtgcatccgtgccaactgcatggtcagggttgaaccgccctgttgcctgccgccttgtacatagctttgccagaacccgcgtaacaggctaatgggattaacaccgggatgataatagaaaccgcggtcttcatgcagttggataccctgtatcaccaatggggagatctcttccaacggtgtccacaggcgataacgatcatcattagccagcgaaaggcgtaatagcgtgccgtgccgatcatagtaagccgtagagagtgggagcccctgagacaagggcgggtgtggccacagccgaaagccgatgaccaagagggccaacagaaagagggccatcaggatattttgcaacaggcgtttggttgccattaaggttgggatgcgcatctggttacggctgaaatccgatagcgccccggcgatgcggggcgcgttgttttcagctattttgcctcaggtggaacgacaaggatatgccctttaccgaccgacagcgcctgtacattacgatcatacatggcttcgccgtaagccggtggcaccacaaagcgacccgtattggttgatttgatttggtagataaactctttaacgtcggtactggcactgccataaatgatcacgcgatcttcacgaatatcactgtagtcagggtaccaactggagccagataccattagcggcgactgccagccgctgccagtttcctcatcctgattatcataaaactctggttcaggtgccgtttgttgtatcacttcaaaaccgcccggcagtagatcgacaatcgccagattattttgaccttgtttagcgttagcccggatttttaggtgcacgttaactttctgccctaaggtgacttgggtcaccggcttaccctgctcatcggtgtagctgcggctgatttccagcccattagagatggcgtcttttggtggctgaaggtcatagcctgattgattgaccacataccaagcgggtgccgaggcatagttgttaaactgaatcgctttagcctcaccggtaaaatcaccttgaacgaacaggccgttcagcgttgagataacgttagggtcgatccctttgcttttactgatctcgatgatttgcagggtttctggcgtatcttgctgggcggctacctggctggtgtaactttccagtgccagaatgctcatcgcggatgaataggtcgtgtaatgctcatccctcagtgccagcaccatattttccagtgcttgtggcggaatagaagagactttctctgggaaatggcgagtgatcagatacaaccgggttgcatcttgcaccagtggatcaaaataattctgcgtccaccaggccttgctgtaggctttacccagttgtttccaggtgggttgcagcagtttattggcttcgtcatccattttgagcagacggtatgatgaggccagataaatggcactcagatcagtctgccaactgtcaggataaagttgctgtaacgtactttgcaccgatgccagagtattggtggtgatctccccctgcaaggtcaacaggtaaacagcaaaggcccgcaaacgcagagagtaaaggtcatcataaggtcgagccgctaacagacgcagtgcgttgttggccccctccaagatgtcattcggcaagctgtaaccggcagatttcgcttccagcagaaattgcacgacataaggtgtgacaaacggatcaggggtaggggaggcgtgccacaaaccgattgcaccagtgctattctgccgagagctcaggatacgtagcatgtttttcagttgatcacggacctcattctgattgagggcactgtccatttcaggatgtttgctttgcataatcaacggaatcgagcggctgacaatttgctcagaactgtagtacgggtaatcagccaggtaccgcgccagaccttgggttaagaccaacggtgagtgggaagcggtcgcctgacgttgagcataattatcaaacatctggcgcagattggtcacagtatgcttgttaccctccatccggcccatcaccgattgcgttcggaatggcatcgccgggcgtaccgaggtactgaccgtccggcggctggattgagagccatagctggcatcaaacaccagtggagcatcacccaatgctgaacgggcgcgtaggcggaagctgacaagcgtttcacgtttttctgccagcgacaggctgtgttgcgcttcacccaccacttccagttgtggcggtggtgtcagacgcacggtgatatcaaccgctttacccttcaatccttgcaggttgttactcacacccacggtgacatcaaattcatctcccggtgctaccatcgcggggacattcggcgtcagaataaagttatcccgcacggtggtcgaggtctggactttaccaatgcgatcaggggtcgcagagatggccatcacgcgaattttaccattgaaatagtcgggaatcgggtaattgaaggtggtttcaccattcacttcggtgataccagaccaataagccaccggcttgtcttgtttgcgtttaaacggattgaggtgcagatccagcccttccccggagtcgcctccaggtgcggaggtcagtgccatcagcttgctgaattccggcaggatcaaatcgagaatttgtgcactctgtacactcagttcacgtttacggaagaagtaatccagtggatctttcaggcgatagcgtgccacctgcaaaataccttcatcgacggcaaacaccaccacgcgctgtggtgaatcggtggtcactttaatcggtaacacttcacccggtttaatgactgacggcgacgctaactcaatagccgcctgacgcgctttggtactgatcttaaatggcatcacaccgtaactcagtgggctcataaagatctcatcggaattcacatcacgcacgaattgtacgttgatatagccattgccttccattgccggtgggatgcggattctctgcacagagctggtggtatcactgtggaaccactgccagctatacactttatctttttctatcgtgatcagaccgctaccggcataaggtgcattaatcgcaatctcaatttcttcgccttgcagatattcggcctgattcagttttagctttaattcggtgttgcgatccagtgagcgggtcaggtttgcgttacccgccaccgtataactaatacggttcagaacctgcccctgactgtccttaactaccagaataaaatcaccaggctgctgggtcactagggtgaaatccgtccctgtcgggctgatttttagcggttgctctgagaccaactgctcctttagccgtgattgatatttataaacgcctgaatcctgtttggttagcactgaaatatacttctgctcaatcaatgacagactcaagtctggcagcgcaattttattcaggctcgggtccacagcaataatattcagcttacgcacggcatcacggttgatataactcagatcgccatcggctttcaccccaaccagagagtcgtaaggtgaaaccagaacccgcgcagtcgcggccacggagcggcctccacccgcttcaaaggcttccgacaacaattgcagttgataggtggcgtcagcataggatttcagatccaatgggatggtcgccatcccttgtagatcggtcgtttgttcttccagttcagtctcaaaaccatcgctgttatgacgattctcatagaacaggtaatcagggaacggggcaaaacttgggtacattggccgcaagatcagtctagaggtgacacggcgctcctgtgctggtgtaccgaataaattttgtacattgatattggcttgcagctcctgcggtttaacccagccttgttgacgctctggcgtcagttgcagttgcacttttaggcgatcaggctcgaactctttaacatttacggtggtgtgccccagcaacatcgacgtttcattattcttaccaaccagatagagatagacgttccattcaccggtaggtgagttttcaccggtcgtatagctgagctcattgaaaccactgctgtccaaggttatcggcagggtactcatcaaggtatcacgtgggtcacggatctccgcccgcagggggacgccatcgagtgcggtagcccagttggcggtccgggtgatcagaccaatattgaagcgatcgcctgggcgataaactccccggtcagaaaacagatagctgcttagagtacgtgggtcggacggtgtctcttcgccatcaatatcaaaacgtgagaaatcaaggttacggtcataggtggctcgggtgggcaggaaggagacatccccttctttttccaccaggaacatgaccggttggcgttcatttttaaaggcgtccagcgcaggaaaatgaacatgccctttgctatcggtgatttggctcagtaagaccacaccattttttgccaccacagagactttggcatcggcggcgggcagacccgagtgaatggattgcacaaacacatcacgggatctatcctgtgattgcttggtgataatgcctaagtccgtgatcaccacaaagcgtgaatcgccgacccattcctggtcttcgtcgtagtcttcctcgctgtgttgctgattatcccttttctcctgatcccaagctgacagggtgagtaagaacaccccacgccgagcactcggattatttgcaagataacgggacagatcgaccccttgataattgatctcgccggggttgtcattattcagcgcggtttggtactggaagtgttcagtaaaatattcatcactcaggcggttaaagtgagctgatgaatattcgctgcttttaaatgacacaatatgttgtaactggctaggaataacccgcttaatatccagcttcatgccagtcatattacgggcggcgacgctgatctgcttatcaccctgcatcgataataacgagccttgtgacataaagcgcagcgtcttagggtaatcgggaaccctgactatttggtagattttttccggcattttataaccacccaccgatgtcaggctattgttaacctcgatcagcagtgtgcgataggaaggggcatcaaacttaaagctgaatattggctgatactcttgctcggcctcattgagggtcagcgccagcggcgttgattgttgcagcagattatcgtcaatatcatccatatcccaaggatagaaatcggttgatgttttggcgctctctttcgcttgaaaattatgttgcggcagtaaccaggctttgaccgcatttttgatctctttatctttaaccgcgtcgctgatagcaataattaaggcccgctcaccattattgttatctgactcaaccaacgtggcattaatactattaaccgccaggctatataggttagggacggatacccatttattctgtgcctgtgtcgtaggcgtggcggcaacactggcattcacccctttattaatcgatagatggaccgaaccgcctttatccattggcatcaagggttgcgaatgtatccaggcattaagctttttctcatcataaacgacggagaaattaagtttcttctctgacttggatttaccttcgaccaatcccaagaggatctgtttttcaaagctggcaacatcaactggggcattaaattgcacatggaaaatagtgctgcgcttttgggcctcttgcggatcctgataatattccgctttttccaattgataagcaaaagctggcgttgtgaaattaagttcggtctgattgagcttaatctgtggtgctaaaagtttttctgcatcgatcgtaatttggtagttagcgcccatcggccaggcttttttgggggtaaacaccaacgtgcgttcagttgcccatttccattcaccctctatcgcgggggttaatgagatgccctgatcgacgacctgacccatcgcggtgataggtgcggctgaatgcataaaattaaggctaagcggctgggcttctggtttttgcgcctggtagttaaccgttcttggcgtcgagactctgatactggtttcctgataaaccataggtgccggttcaatcggttggggccgattaagataccagtgatagccatagaatgtggcgctggcggcagccatcaacagcactattgccgcgctgatccctttgggatgcttagcgacccattgctctgaacggttgaaagcacagtgtagcccgttggcggttttcgtcatccattgtggcgcgcgccaattcaggttaccgacgactgggcgcaataggcggcccactaaccgtaaaagataagcgcttaaccgatagagtcccttgataagggcgaagggggagatcagcagaaacctcaacaaatccatagataataatcctttaaacaccagacagcacaacaacccaagaggttagttactgtccgcggacggataagtcacagtttccccattcaggttatattttatcagggataataggtgaaataggggggaggggctaatggtaaaaagcctcttattgatccaatatataataattcagataaaacgcgcatctattaggatatttcagacatttatacaggatatttctgatctccatcacagggggacctcattagatcacgtcaatattctttttttaatttacctaataacctcatttacttaataacccaattgacctgaaccctaaaaacgaagctatggcagagtcatgccctgagagcgtttcagggcgttggtacagcagatgataaagatcacaataataactcatggggattcttagcctattcacatcaggggcgtcatttttaccctttggcgaaagagttattttataaacagtttgttacccgtattatcttactgttcactgccgcacaggcagcttagaaaactttcggagacagtgattctacgaccgatgcagttcactgccgcacaggcagcttagaaaaagccaacgacggatctcttcaacggcaatgcgttcactgccgtacaggcagcttatagagggttactgtctgtgcgccagcgcggccccagcctgcgcctcctgctggtaggccaacgccacgaccagcgactgcactagacagagcgtggctgattgagatcggaaggcatctacctgagcctctttcaccacaaaacagagatcgctgaacgtggcgagcgggcttatctggctgtcggtaatgacaatctgccgggcacccgcgctagcggctatttcactgaccatcacggtctcttcggcgtaaggagagaaactgatagaaaccacgatatcgcgtgctttaatgctgttcacctgctcgcgcaacatccccccgaggccatgaagttgcactgggcgacattctaaatggctgagtgcgtaggtcagataggcggccacgctgaacgagcggcgcaggcccaccacataaatggtatcggcctgagcaagcagttccaccgcacgttgcagcatctctggttcagtacgtgccgccaactgctgtagtgcctgagcattggatcgggcaaactcttgcaggataccgagtggcgtttccggcacggcttcgctttccattgcgcgaaacagccgtgcacgatcggtataactcgcggtctcttccaccagattcatacgaaacagttgtttcatctcgttgaagccgctgaaatcaaaggcgttagcaaaacggattaaggttgacggaggcacgtctgcgcgttcggcaatgacggcgacggtgtcaaacgccacgctgttggtattgtccaacacatagcgggaaacctgctggagccgcttactcaggttgtcgtaacgatcacggatctgctgctgtagttcactcagattgcttgctgtagtcattatttctcccttaatacatgattatgattgtaatcgctcgacggctgtttttaaacgcctgctactcgaccacccacaaaatgaaacagacgctccgggagaatggagacgataatggcctttaatgcgtcagcctttaatacttcagcctttaataacttcagtcatctaatacctcaatcatctaatacctcagtcatcgccagtcatgcagtttgttaacataaaaacccatcattgatcacaatatccaatatttattttattttaacttaaagtggaacgtttgttttatatacagtgtccaggtgtcagtcaccttttaacagcgaggggtcaacatggagacggtagcgaattttattaatggcaaatgtgtttttagttgcggcaacagtatcaccagcggtagcccgcgcgctcagacaatcttcaactcagccactggcgaacctatccgtcaggtgatgatgagcactgcgcaggagaccgagcaggccatcacggcggcacaacaagcgttcgccagttggtcgcgccaagcgccacttaaacgcgcgcgcgtgatgttccggtttaaaagtttgctggagcagcatctggacgcattggcacagcttattagcgaagagcatggaaaagtgtattccgatgcggtgggtgagctaacccgtggtctggaagtggtggaattcgcctgtggcattccgcacctccaaaaaggcgaacactcagccaatgttggcactggcgtggacaatcactcgttgatgcagccgctgggggtgtgcgtggggattacgccctttaatttccccgcgatggtaccgatgtggatgttcccgatagccctggcgaccgggaatacttttgtactgaaaccgtccgaaaaggatccgtcgctggctgtgcggctggcacaacttttaaccgaggccgggctaccagacggtgtatttaacgtcgtacagggtgataaaaccgcagtggacgtgctgttgaccgatccgcgagtgcaggcagtaagctttgtcggttctacgccgattgctgaatatatctaccagaccgcatcggcccacggaaaacgctgccaggcactgggcggggccaaaaaccactgcattctgatgccggacgccgatatggacatggcggctagcgccattatgggcgcggcatacggcgcggcaggggagcgctgtatggcgctctcggtggtgttggcggtgggggatgaaacggcagataacctttgcgcacggctggaacagcaaattagcacgttacgtgttggtccggggctggcacaggagccagaaaacgacatggggccgctgatctctgcgccacaccgcgcgaaggtattggggtatatcgacagcggcgtggcccagaaggcaacgttgcgcatcgatggccgtggtttgaaggtggcgggccatgagcaagggtattttgtcgggccaacgttgttcgatcatgtcaccccggccatgaccatttatcaagaagagattttcgggccggtactttctgtggtacgtatcgcggattatcgcagtgcggtggatctgatcaaccgtcatgaatatggtaatggcacggctattttcacccgcgatgggggtaccgcacgccgcttctgtgaggaggtacaggtggggatggtcggcgtcaacgtgccgatcccagtaccggtggcgtttcatagcttcggcggctggaaacgttcgattttcgggccgctcaacgtgcatggcaatgacggggtgcgcttctacacgcggatgaaaactatcactgcccgctggccagaagcacagcatgatcagggcgcggcattctctatgccgacactcggttgaagggagaggccgcatgagcaccgtaaacatggcgatgaaaacagtacggatgaccatggcacaggcgctggtcaggtttcttaatcagcaatatgtggccattgatggtcaggaggtcgcatttgtccacggcgtgatgacgattttcgggcacggcaatgtactcggtatcggccaggctctggaagaaaatccgggccatttacaggtgcatcagggctgtaacgagcagggtatggcgcatatggcgattggttttgcgaaacagtatcgccgtcagcgtatctatgccgtcagttcgtctatcgggccgggagccgccaatatggtcaccgcagcggccaccgccacggcaaaccgcattccgctgctgctattgccgggggatatctacgccagccgtcagcctgacccggtgttacagcagatcgagcaatatcacgaccttagtattagcactaacgattgcttccgcccggtatcacgttactgggatcgcattaatcgccctgagcaattgatgagcgccatgctgagtgctatgcgagtactgactgacccggcggataccggtgcggtgaccctttgtctgcctcaggatgtgcagggcgaagcgtgggattacccggcgagcttctttgagcgccgggtgcatcgtatcgagcgccgtccaccggatacgcgcaggctttctgatgcgctcagcctgatcgcccgtaaacgccgcccgctggtggtgtgtggcggcggcgtgcgctattcgggggcgcatgaggcgtttcgtgcctttgtggaaaacgctcaattaccctttactgaaacccaagcaggcaaaggggcgctgccaagtgatcatcccctcaacttggggggaattggtgtcactggcgggttggccgctaaccggttagctccacaggctgatctggtgatcggcatcggtacccggctcaccgatttcactacgggttccaaagcactattttctcacccggaggtggcgtttttgctgcttaacgtggcggaattcgatgcacttaaactggatgccacggccctgattgccgatgcgcgggtggggcttgaggcattaaccgaagggctggcaggttatcgcactgcttggcagggcgatatcattgaggccaaagcagcgtggtgcgacgaatgtcaacggctttggtcacgcacctggcggcctgatgaggtgccagaggtggccggtcatcttgatgattcgctacaagaatacgccgaggtgctcaataccacactgacccagactcgggtacttgggcttatcaaccagcatattgaagacgatgccattgtcgtgggggcggcggggtcgctgccgggggatttacagcgtctatggcaggtaaaaacggcagacacctatcatcttgaatacggttattcatgcatgggctatgaaatcgctgccgccatcggggcgaaaattgcgatgccacatcaaccggtgtacgccatggtgggtgatggctcctatatgatgctgcattccgagctgcacacggcggtacaagaggggctaaaaattaccgtcctactgtttgataacgccggattcggctgtatcaacaacctgcagatgggtcacgggatgagcagtttttgtaccgagagccgccaccgtaaccacgagtcggggcaactcaatggcccattgatttgcgttgatttcgcccaaaacgccgaaagttatggctgccgcgcctggcgggtgcacgatgaaccaagcctgctagcggcattggcagcatcccgcgatcatccggggccggtgctactggatattaaagtcttgccgaaaagcatgacgcacgattatgcgtcttggtggcgtactggcgatgcgcaaatcgcccgttcacccgcggtacagcaggctgcagagcgaacccagatgaaggtaaaacgtgcccgtcagtactaaccctccgttatcctgcctgttcatccgtcgttggctgcaaaaaatggggttagttttagaaaatgttgtgactgtgatagcaaaattaactcactttattaaaaaaatgttaacttctgctcaaaaaatgtaattttcacttttcattaaaatgaaatgaatgttttattgaataaaggttatgttttattgggcaaaggttataccgcagtattgctttcgcggtgtaccccagtttttaggggggattaccagaccaccgagatatcgctagatcaggagcaggagccgctatgtttaacattgccttactgggcgcaggccgcatcggccaggttcacgccgccaatattgccgcccacccagagaccaccctctggtctgtggtggatcccaatcaggaaaacgcggctcgcctcgtatcacagtatcggacccgtcagcagagtgtgaatgaggccatggcagatctgaacgtccacgcggtgttgatcgcttccgccaccgatactcatgctgatttgattgagctggcagcaaaacacggcaaaaccattttctgcgaaaaaccggtccatctcgatcttgcccgtgtgcgggattgcctaaaagtcgtgaaagagtatggggtgccgctgtttatcggttttaaccgccgcttcgatccacagtttcggcacctcaaaaacgaggtgttggcagggcgcattggtaaaccggaatcgttactgattatctcccgcgacccgtcgccccccccggtggagtatgtgcgcgtttccggcggtatgttccgtgatatgaccatccacgactttgacatggcgcgtttcatcatgggcgaagaaccggttgccgtatttgctcagggtagcaatttagtggatcccgccattggtgcggctggcgatatcgacaccgcgtttgtggtgctgaaatacgcctctggcgcgatggcgaccatcgtcaacagccgccgctcggcttatggttacgaccagcggttagaactgcatggatcgcaggggttgctgtgcgtgggcaatattctggaaaaccaggtacagcactttggccaaaaggggggtacccgtgcgttaccggagcattttttcctgcaacgttatcaagccgcctatgctgcggaatgggaacactttgtcgctgttttacgcggcgatgtgcaaccggaatgcggtggtgaagagggtgagcgggcgttgtatttggccgacaaagcgctggaatcgttgcacagccagcgtgaaatctccctgtaaattttgaccgaccttacagcatctatcgaccttacagcatctatcgatcttacaacatctatcgattctacaaccctctagaccttacaaccgtaccgaccctacaacgataaagagagataacaatgaaaaagctgatcctcgccgccctcatcgtattcacttctggggtggcctttgccgagaatgaacaaattgtttttagtacaccaaatctggcgatgccgtttgaagtgcatatgcagcgcactgccgtgaaaacggccaaagcgttgggtgtgaagttacaagtgctggatgggcagggcagttcgcctaagcaggtggctgacctggaaaatgccatcacccgtggcgcgcagggttttattgtctcgccgaatgacattaacgctatttccagtgccgtagaggaaattcagcaggccaaactgccggtggtcacgctggatcggtcagtcgagagcgagaaaaaagtgccgcattttggcgcgaataattacaaaggtggcgaggccattgccaactatgtgaaatcgatgttcccgaacggcgcagagatcgtgctactcaccggtcagcccggttcctcctccaatattgaacgaaccaaagggatccgcgacagcctgaaaacggggggtgacaagtatcgtatcgtcgtcgatcagacaggaaactggatgcggtcagaagggatgcgcattatagaaagcgtactcccatcgctgccaaaacccccgcaagtgatcctctcagccaatgatgatatggcgctgggtgccattgaagcattacagagccatggcatgaaaccgggtgaaattatggtgacaggtttcgatgccgtgccagaggcgctggcacgtgtacgtgaagggtggatggcggtgacggccgatcaacgtccgggttacgcggtgacaaccgccatgaaccaactggtggcgaatatccgtgaccaaaaagcgatcaccggtgcagatttcttgccaacgatgatcaccaaagaaaatctagaccaggccgagcgcgttagcgaagcgggtaagtaaccctgtcagcgtcgccgcgacggaggcggcgtcaggaggagaacaccgatgtcgcaacctttattgaaaatcaccgatatggcgaaaagcttctctggtgtctgggcgctcagtaacgtacagctcaccgtagagcagggtgaaatacatgcactcttgggtgagaacggcgcaggtaaatcaacactcttgaaagcactctcgggtgctcaaccccagactcacggcgaaatctggtttaacggtgaaatgctggcattggacgactcgccagtggaacgccagaacaaaggcattatcaccatctatcaagaagttaatctactgcccaacatgacggtggcagaaaacatgtttcttggtcgtgaaccgcgccgccgtcaggtatttgtcgacgaaaaagccgtcaatcaggaagcccaagcgatcctcgattacctgcaacttaacgtgttgcccaccacggcggtggcgcgcttgagtatcgcgcagcaacagatggtagagatcgcccgggcgctgaccttgaacgcgaagctcattgtcatggatgagccttcggcagcactcagcgacagcgaagtcgaaagcctgcatcgcgtggtacgggaactgaaaggccgtggtgtgagcattatctatgtcacccaccgcttgcacgaagtgttccaactctgtgaccgtttcacggtgtttcaggatgggcgttacaccggttctgatgaggttgcaggcaccaacgttgagaagattatccgcctgatggtggggcgagacgtcgtatttaaccgccgccccgccagtgagacccatcaccaagaccagcccattcgcctatctgtgcaagggctgtgtcgtgaaaaacccccgctcgacccacatggtgtggcgctaaaagacatcagctttcatgtccacgccggggaagtcttgggtatcgccgggttggtaggggcagggcgtaccgaagtggcacgttgtctgtttggggcaggggctttcacctctggcaattttgagatagacggtgtgccctatcagccacgggatccaatgttcgcgctggaacaggggatcgcactggtgccggaagaccgtaaaaaagagggggcagtgcaagggctttctattcgcgacaatctgacactttcgagcctggccgggctgttacagtggcgttttttcgtcaatacccgcaaagaagatcaactgattgagacctaccgtttagcactgcaaatcaagatggtgaacagcgaacaggcggtgcgtaagctctctggcggtaaccagcagaaggtgatcttggcccgctgcatggcgctcaatccacggatcctgatcgtcgatgaaccgacacggggcattgatgtgggcacgaaatcggaagtgcatcaggtgttgtttgatatggctaaacagggcgtggcagtgatcgtcatctcctcggatttaccggaagttctcgcggtttctgaccgggtcatcacgctaagcgaagggcgagtcactggagagattcacggtgatgacgccagcgaagaacggctgatgaccatgatggccatcaatcataacgccttaaatgccgcctaacggagcacctcatgctacagccgctttccaagccccaggcatcggtaaaaagcgcgatgcgttttgacccgatcactttttttgaacgcttcggcgtcctgatttttatgttcctgctgctgattttcttccaattgcagaacagtaattttctctcagaacgcaatattttcaacatcctaactgaggtatccatctacggcatcatggccgtgggcatgaccttcgttatcctgaccgcgggtattgatctttccgtcggctcaattcttgcggtgtccgccatgacagccgcttatgtgattaaaggcgataactttaccaccattgaccccaacgcttggggcggcatgagttggctaattggcctcagtatttgtctggcaatgggcacccttattggttttttgcagggcttgggggtcacgcgtctgcgtctgccgccctttattgtcaccctgggtgggatgaccatctggcgtggcctgacgttggtgattaacgacggtgcccctatcgccgggtttgatgcaggctaccgctggtgggggcgcggggacttactcggtatttcaatacccatttggatttttgccattgtcgcgatagccggttatctggcgctgcacaaaacccgctgggggcgtttcgtctatgcgattggcggtaatcctgaagcggcacgtttggcgggagttaatgtgaaacgcgtgctggtcagcgtctacgtggtgatcggctgccttgccgggttggcgggtttcatcctaagcgcccggctgggcagtgctgaagcggtagccgggatctcgtttgaattgcgggtgattgcctcggtggtgattggcggcacttcactgatgggcggctacgggcgtatcggcggcaccattattggctccatcatcatggggatcttgattaacggtttggtgctgatgaatgtttcggcttactaccagcaaattatcaccggcctgatcatcgtattggcggtggcctttgatacctacgccaagaaccgtcgcggcgcgctgtaatacgttcatgtcaggagtgaatgatgaaagaagtgcgtattggattgattggtaccgggtatatcggtaaggcgcacgccattgcctacgcacaggcaccgacggtgtttgaattgcgcggcaaactggtgcgcgaaatggtggccgaagtctcaccagcgctggcggcacagcgtgcgcaggctttcggtttcaaccggtttacctgcgactggcgggagctggtcgcggatccggctattgatgtggttgatatttgctcacctaattatctacataaagagatggcgctggcggccatccaccacggcaaacatgtctatgcggagaaaccgctggcgctgaatgcccgtgacgccagcgagatggcggcggccgcaacgcgcgctggggtgaaaacgttggtagggttcaattacatcaaaaaccccagtgcgaagctggctaaagagatcattgaacgtggtgaaatcggtgaggtgatccacttttatggcacccataacgaagactatatggccgatcccaatacccctattcactggcactgtttacaagcgacggcagggctgggaacacttggcgatctggcggcccacatcgtcagcatggcgcaatatctggtgggggaaataacgcaggtatgcggtgatctgaaaaccgtcgtggtgacacgcccggcgagcgttggctccagcgccagagtggcggttgaaaacgaagatcaggcccatgccatggtgcgttttgtgaatggcgctcagggagtgattgaagcctcgcgggtggcttgcgggcgcaaaatgggcctctcttacatgattaccggtactcaaggggcgatcagttttacccaagaacgtatggcggaactcaaactctacctgcacaacgacccggtcaaccgacaaggcttccgtaccctgctcgtcggcccgacgcacccagagtatgccgcgttctgtatggctgcgggccacggtattggttttaacgatcaaaaaaccgtggaagtgcgtgacttgatcgacggcatcgcgatggacacgccgctgtggcccgatttcgccgagggctggaaagtctcacgcattctcgatgcgattgctctgtctcatcaggatagccgctgggtgaatgtgaccgacattgtctgaggatggggtatgtctgaggatgaggtatgacagggtctgagggggggtatgagtgtggaaaagcaatttagcgttagcgcggaaaagacatgtaatacggaaaataaatgtaatacggaaaaaaaatttgatgtcatatgcatgggccgcattgcggtagatctctacggtcagcagattggcgcacggctagaggatgttgccagctttgccaaatatctcggcggttcatccggcaacgtggcttatggttccgcccggcaggggctgcgctcgtcaatgttggcacgggtgggcgacgagcatatggggcgttttctgcgtgaagagcttcatcaggttggctgtgataccagccatctgaccacagataaaaagcggctcacggcgctggtactcctgagtattaaagatcgagacacctttccgctgattttctaccgcgataactgtgccgatatggcgattacggcgcaggatttcagcgagcaatacatcgcctctgcccgctgccttgccatcacgggcacccatctttctcatccaaacactcgtgaagcggtactgacagcgctgcgctatgcacgccgcaatggagtgcgtaccgtgttggatattgactaccgcccggtactgtgggggctgacgtcgcttggtgacggcgaaacgcgctttattgaatcccatcaggtcactgctgaactgctcgcagtattcaatttgtttgatgtgattgtggggaccgaagaggaatttcatattgcgggtggcagcaccaatacgctggatgcactgagaggtgtgcgtgaggtcagtgacgctgcgctggtgtgcaagcggggggcgctgggttgttcggtgtacaccgaggccatcccgcagacccttgatgaggggttgaccgttagcggtgtgcgggtaaaagtgctgaacgtgttgggcgcaggggacgcatttatgtcaggtctcctgcgcggttatctcaatgatgaaggttggccgcaggcatgtcgctacgccaatgcttgtggcgcactggtggtctcgcgccacggctgtgcgcctgcgatgccgagtaaaattgagctggataattatctggcgcgggcagatgccgtggtgcggccagatcttgatgtgcatcttaaccatttacaccgcgttacgacgcgccgccgccagtggcccgagctgtgcgtgatggcctttgatcaccgcagtcaactcgaagaaatggcactgcaatgcggcgctgatctgtgccatatctcgacgctcaagacactaattttacaggccagccgtgaggcagtacacactgccgggctgcaggggaaagcggggctgctgtgcgatggcacttttggtcaggacgcccttaatgccattacgggagcaggctggtggattgggcggcccattgaactgcctggctcaaggccgctggcgatggagcacggcaatattggctcacaacttattggttggccgcaagagcatatcgtcaagtgtctggtgttcttccatccagaagatgcctacagcctacgcctggagcaggaacagaaaattattgaggtgtaccgggcgtgttgccaatctggccacgaactgctgctggaagtgatattacccgctggcatgccacgcagtgatgaactctacctacgtgctatttcacgcttctacaatctcggggtctatcccgattggtggaaactgccgccactcgcctcagagggctgggcggcgctgaacaaactgattgaacggcgcgatccgcactgccgcggcgtagtgatccttgggttcgatgcctcacttgaggcactgcgcacaggctttaatgccgcggcgggctacccgatagtcaaaggttttgccgtagggcgcacgctgtttggtgacgcttccctcgcttggctaaagcgcgatattgacgatacgcagcttattgcccgcattcgggacaactatctacagctcattacgctgtggcgtgagcgcgggcagaaataatcttcaggagaaacatgacgatggtggatcaaagaacggcggttgaaccaaaaacggcggttgatcagacaacagaggttattcgaaaagtagaagttgctcagaaaatagaacgtgatcggaaagcagaggttgttcgaaaagcagaagttaatcagaaaatagacattgttcgaaaaacagagatagttcgaaaaacagagacagtgcgaaaaacagaagctgatcggcataccaccgcggtgcagttaggcattaatccgctgacatggactaacgacgatctgccttctctgggggcggaaacatcgcttgaaacctgcctgagcgaaggtaaagaggcgggttttgcgggctttgaactgggcaataaattttcacgcgaggcgggggttttagggccaattctagagcatcatcaactgaaattggtctctgggtggtattccgggcggctgttggaacgctcggttgaagaggagattgtggcggttcggtcacatctggcactgctgcgtgaactgggggctaaggtgatggtatttgctgaagtgtccggttgtattcatggtgaacagcaaacgccagtgcatctgcgcccaaggtttccgccagcgcgttgggcggagtatggcgcgaagctcaccgcctttgcccgttacacgcaggcactgggggtgcagattgcttaccaccaccatatgggcacggtgatcgaaagcgcgcaagatatcgataatctgatgattcatactggcgaagaggtcgggctgctactcgacacgggccacctcacctttgcgggggcggatccgctggcggtggcacaacgctggattgcgcggatcaaccatgtccattgcaaagatgtgcgcacgtcggtgctggccgatgtcaaaaaccgtaaaaccagttttctggacgcggtgttgagtggcgtatttaccgttccgggtgacggcggtgtggactatccactcatcatggcgttactcaaacaacacggttatcagggctggctggtggtcgaggcagagcaagatcctaatgtcgcccacccaatgacctatgcgcgcatgggctaccacaatttaagccgtctggcacataacgctgggctgatttaagggggtcatatgtcacgtttattatcacgcaggcaggcaccggatgagcggggcctgacgcagcgaatcactccagcgcaggcgggctgggggtatgtggggtttgaggtgtatgaactgaatgaagggcagccactgacgctcaccgcggttcccgatgagcgttgcctggttttgatcgctgggcgcgccagtatcagtacgcccagcgcacaattccctaacataggtgatcgcatgagcccgtttgagcgccataaaccttgggcggtgtatgtcactcctggcgaagcggtacaggtgcaggccattaccccgcttgaactggcggtttgttccgcccccggtaaaggcacttacccaacccggctgatttcgccagaggatatcggcgcagaagcgcgcggtaagggtcataaccagcgctatgtacacaacattttgccagaagatcaccccgccgatagcctgctggtggtggaggtttataccaacgaaggggcgagcagttcatacccgagccacaaacatgacactgacaacccaccacacgaaacttatctggaagagacctattatcaccgccttaatccagagcagggcttctgtatgcagcgtgtttatactgatgaccgctcacttgatgaatgtatggcggtttacaaccgcgaggtggtcatggtgccaaaaggttatcacccagtagcgacgatggcaggctatgacagctattatctgaatgtaatggctggtccggtacgtaaatggatatttagctgggaaagcgagcacgtttggataaatcataattatcctattacataaattgtttattatgtaataggttgtttattaattagtcaacaagaaaaggattaaagttttattgtgaataaccaaatcgctttgtttttattcgtttgagataataaatttatactgtaaaatttagtttttaatataatggaatgactgaggctaacatggatttttcgtttaatcccacagaattaggatcatggattttttatatcattgttttttcaatgatatattggcctgttgtcgccgcgatgtgcgtaggtttaatcgtggcggctgttcttcgtaagcggtggttcatcattattttcgctgtcccactggctctgatcgcgttgtcctttatcacgctcatgttgatgtgattgacgctatcggttaaatcctgcgcacttaacggagcaggaaggcgatattcacttattgcctggctaaaatgccactgattttggcgatataaaaagggtttgctgcaatgtgcgcggctattattactcggagattgcacagatagctgtcagaatataaggcatgaatattgttgctttgccagagatgaaaaacagataaatatggatcgttcccgcatactcaaatttttgctgccttatttatggcctaaagataatccgaaactacgttactatttaataatcgctttatttttcatggtgattgctaagatcagtacgacactggtccccctggcgtataagtcgatggtggatacgctgagcagtgaaaatgccaaaatgctggcaatcccgatcagccttatcatcgcgtatggcgtagccagagtcagtgcttcgctgttcgaagagttgcgcaatgtgatgtttgtgcatgttagccagaacgcaacacggctattgggtttacgtgtattcaggcaattgcatgccttgagtttgcggtttcacctagagcgccagactggcggtctatcattatctattgagcgcggtacacaggccgtttccacggtactgtcgcgcctgctattttctattctccccattttatttgagataaccttggtctcggtgattatgtggcggttattaagtggctggtttgctctcgcgatccttgtcacggttagctgttatattttattcacggtaatggcggtgggctggcggactcggtttaggcgtgaattaaacaaagcgaatgcggatgcgaatactaaatccatcgacagtttattaaattatgaaactgtaaaatatttcggtaatgaagatttcgaagcagaacgttttaatctatcgcgtcagttatatgaatatgcggcaatcaaaaaccagatcagtttcaccgtactcagtttcgggcaaactgcgattatttccgtcgggctgattgtcatgatggcaatggccgcgcagggaattgtacaaggccagatgacaataggtgactttgtgctggttaatgcctatctcttgcagttatatcagccgctgaattttttcgggtttatttattcggaaattaggcaggccctgattgatatggaaaatatgctcgacctcttgatggtaaaacaagagataacggatcgccctgatgccttgccattacagttgacgaaaggggaagtgcgtttcgatgcggtgagttttagctatgatccacgtcggccaattctgaataatgtatcgttcactatcccgccggggaaaacggtggcgattgttggcgcgtccggggcagggaaatcaacgcttgctcgtttgttgttccggttttatgacgtcactgcgggggccgtttacctcgatgatcaggatattcgtggtgtgacgcagtcgagcttacgtgaggccatcgggattgtaccgcaagatacggtgctgtttaacgatactctgcgttataacattggttacggtaaaacagattcgaccgatgaagagatcgagcgggcggcgaaattagcgcatatccacgagtttatcatcagcttaccggatggttatgaaactcgggttggcgagcgggggcttaagttatcgggcggggagaaacaaagggtggcaatcgctcgcaccattttgaagaaaccgtcgatattagtcttcgatgaggccaccagtgcccttgatacccacaccgaacgagagattcaatctcatctgcgggaagtcagccgtgaccacacgacgctggtgattgcgcatcgtttatcgaccatcattgatgctgatgaaattatcgtactggaggcgggttcaatcgttgaacgtggccgccatgacgaattgctgctaaagaatggccgctatgcgggtatgtggcaaaatcagtatcatgaagaagaagcgtatcatgaagcagagcagcctgtgctgtaaggatattgtcggcggttattccagtggcctcataagggtaaccgcacacgcctgacgctgataatgattaatttgcggcactaaccgcctgaaatgttcagttgcacaatgggtatctaaagctgcttgatcgggccactcctcgataaaaataaagtggcctggatcgttatgatctataaataaatcataagagagacaaagcgcttccaattttgttttagccactaattctttatacagtggtagcacatcgttaatgtgttccagttttataaaatcctgagcaatgacttttagcatattctcactctacgctccggtaaaataggtataggcgaacacgaccagcgctactgctatcatgatcatcgttgtttttctcattactgcccttgagtctgtcgttagttttaggctagtcgaagaagatagctgaaattattcaaaaaaacacggtatatggataacaatgcatgtcaatcggcggtggttaatcatactcgccgctgtggtgactgaaaattattccccacttttcgctaatgctatagtagaatattacctgttaacttactgattatatttatgttataggcttcgccctattgtagtcaattaggttaataataagttagcattaggttgaatgataaccatttaactttaatcatgagattttagtcacattatctgagtaaatatttgtgttattgttgtttacgaaagtgagtgggggtgtgatatgtcaacactagagaagctggtttctgcgtattgtcataccagtttggactttgtggcatccacagttgcttttatggaaagccaaaaaaagaatattgatgtcgataaaattgaagcaaagctttctgtggatgaacgtcatttttttcgtaaaagattaacgcactacagggatatttacaggccgttgtagtgtgtattgattgaagtctacactgatattaaataagccacctgcgtgatgtgaacctctatcgtggtcatttcatctggtggcttatcaattttaaaaccagttttaatgcctttctttgggggggttgtcataaccactacgaatcgcctttcgggcttcacgactgtactgattgcctgatggctggttttcatggcgacacctttatgttttaaacaacattcaaaaaattgaaaatggcaccaacggacaccgaagccatataccatgttaatacgcaggtgatcaccccgcgccacaacaactaacgtggatagtgataaccttccatcagatctgcacgttcccagataatctcaatcaggtctttttcgattagaatgagataaagcgcgaggtgtatttattcagtaatagggcccgtgacaataagactgaggcggcaaatacggataacagcagcgtaaatctcaacgttacatctgataagttatatgcgctggcaataaagtagaaaatcccatcatgtaatatataaacaccaatcattgatgggctgatatacgccaatgttttctttatccattcatattgagtgtcaaagttatcaaatataacaaacagacataagctgaggactaaaacgtggaagttatcgaggaagtaactcgcattcacggttttatacacgtaaattgacatgaaactttcgtaataatacatcgagatggatgtagggagcagcagtaacttggcagcaagacgaacctttggcaattttgtcaccttctgacaaattcgcgagcagaggaatcggccggtcatatagtaaaaaatccaagtccatagcctaaagtattgtggaaaatcaataaggtatgggcgttcactgaaggcactgatcagatcaatggtcacggagaaaataaccagacaagagagcgtgatgatggctgtcctgttactttttaatatcttggagataatcgggtttatgaggtaaatgatagcgatactaaacagaagccagctttgcaggaaataaccccgtttgaaaccatcttcattaataaagtagaagagaacgttccagaaaataattatggttataatcgattttaattttctgaaaatgtctttctgatcgattttgtcatttgagtcgatatagccaatgatcataaaaaacaacggggtagcaatgatcgacaaaaagtacaaaacgcccatgacttccccacttaaaaagcactgttcagtacaggttttactggcggagtagaacgtaacagcggaaaagcagctcaacgtttttagggcatgtaaaccgacgtttctcataaaataatttgacttacgataaggttaaatgagatctgcaatgtgagagggctgctacgttaaacctcatgcatgacataagatcgcgcactgacagaatacctgctgctatatatttggtgctcagcgagtaaaagaaaacccttcctattcagactacttatagcgttgtctatctttgcatacaatcttaatgctgtcacgcctaccaaacatagctttaagaaataggcaagaaatagcccaaagagaaacagacgtttcctacatattccggtgttgacatcctatatcctcgcacacgcccgccgtggtttactgtatgcataggagtgtgtctggttatctatatgatattcaatcgtattttatcatagagcaaacagataagcatcagggattcacagagtgcttaagcactaatgggcatagccaaaatgataagctgcatgatagtcgataacgataaatatcaaacattaggtatggtatctatcgtaaaaaaaatcttcacatccttaggatttaaaaaagagattaaattctaccgaaaagctttttattcagcagatgtgatttttattggcgtcgatgaattcagttttttcgaggcactcaaacgtctggataagacccccgcagaagcggatgtctttttgatttgtgatgccagattgaatagttttttacaaggtattccaagatttagcgatgtgaccatgatcttcagagaagactcattggaaacggtgagtaataaaatcgctactgtatttaagcgtaagttccgtgggtttaaagacaatttaatcgaacgtaaaacagctaaagtacttcatctagtatcatctgagcgtcaatatctgacaccgaatgaaaatattgtactgaagttattcaatgaaggcttttctggtggtgatattgccagaatcttgaagaaaagtgaaaaaacagtcagtggacaaaagcgctccgccatgaagaaacttggtgcacggactgatgtcgagttaataaaaatgtttatgtttaaataattagcataaggatatctggggttgtcgttatttttattgtcgacaccagaggatgttataagggacgcttttgcatttgcaggcaaggacgcttgcgttaccttctattaccattgctaaaacgttaccgttgctaaaacgataccgctacgatcagcctctatcgccaatcactatcatcaaccatcaacgactatcaccgactatcaccaactacctgcgactggtagccccaaatatttcagggctagctggccttggcaagtcccaaaatcaatattaaatactctttaatttagcaaccgtactatcaatatcgacttcgtgttcagaaaatgtgtatgtcacattttggaatgttgttatcgacagcattttcagtggtacggttttctctgaaatgtcctcttcctgtggcctaattttattcatcagtaagtttactgataatattgtattggctttatcaacctcggcttgagcagggacttcttttgtaaaggtattgaatgacttgatactggtcagctttatcctttcattagcgatgaatatatatttgctctcaatcgctacttttacagcgaatgctgataaccctttggtgttggttgtcggttcaaaggttacttcagcaccctttttgatcatctcgggattagcaacttttataacgtgaaaataacggttatcgccgttttcatcggtgataaaaccaaagcctttatcttcaaaaaaagttgttattctaccgttcatcatgcatctcatattagtgtatccaatggataagtataatacaggtgaatgacgttcagatacagtctggcagtttaccggaggcgtttagaccccgagagggggaacggtgaaagcaagaaaaggtggttttctgtgctggatattcgccagaaaaaagagatttttcactttttctctcttttttgtgatctccattgtggacaaaaaacggttctattgctgtactgtaattgacacaatttttgtgtccaacattcacgttaaaggtaagtttgatgtctaagattaaaggtagcgttaagtggttcaatgaatccaaaggtttcggcttcattaccccagaagatggtagcaaggacgtttttgttcatttttctgccatcgctagcaatggtttcaaaacgcttgctgaaggccagcgtgtagaatttgaaatcacgaacggtgccaaagggccatctgctgctaatgttatcgctatctaagtagcccatatctttaaaaacccgccttactgggcgggttttttatgggtagcgttagcgtacaagacaatatgtttagtctgttacctaatcgatgatcaggcagggagatacccatagcgcattataaggagagattagaggggcttagaagagatagattttaatgaaaactacggtaataaacagacaaaaaatagttgttagccactcaactgatgttttaggcaatccaaacatacatccacccatccagtatttcagtaaccccactcggttagctgtcctctaccagacgattatccgcaccatagattaagaaaacattaaggcgatattattagtagcactattttctactgaataaacactatagccacgctattcactccttgaagtgtttaatcataggccactagccattattggctggcaaagttattgaccaatataaaagccagcatcgtcattgccagtgaacccgccacattgagcaaaattgttccggcagcccacgttaattttccctcttggattagatagaccacttcgacagaaaaggtggagaacgtcgtgagacccccacaaaaaccggtggtaatcagtagcttccaaacgggatcaatatgagtcattcggctaaaaagcgccagtgtcaggccaataataaaggcaccgaccaggttgacgataagcgtacctaccggtaagtgagccgatgcactgtttaacttcaaactgaccaaccaacgggccatgctgcccacaccgccaccaataaacactgcaagtaatgtattaaacataggcacttttctctaacagatactgaccattggggcgttttgtttacccacagatcttttcagaaaggctcgttggtagccctacgtaccctaatgagaaggtcacgtagacatcattagccttgttagggcggttatggaggcgtgtcatctccagatcttgaggggcgatattacactgcttgaatattaatttgtagcttgtcggtttttatcatgacccattttgctggcattattcccaatagggccattaatgcaaggcgataagataataatcatctgaaatccatcataaaatgattgaaatgatattcaactggctaacgtgagggatgttacggtaatgcttcgtagggatgcgccaaaacgctaaacagactcgtgaactcatcatcgttcacttacgaaatctgttacatattagtgttgtctttatcggtaatttattcgtaaatgagccagaatttaactcgttactgttttatacactgaactgctttataaactgaacggttttatagaccgaactgttttatcagaagaactaaccaagaaggtgagttatggaaggtctcagtattaccaaactgttggttgtcggcatattaattgtgttgttgtttggtaccagtaaattacgcacgctgggggcagatttgggcgcagcgctgaaaggctttaaaaaagcgatgagaaatgatgatgaggtttcaaccagtgtgcttggagaaaccaaaatgtcagcggaaaccaaaacagtagccgaaactaaagcggcatctgactcccaagccgcagcttcggttgagcgcaaagactgactctttttgcctgtgcaatatcgccagtctttcggctaaagcgtggcgcaggaagcgtataagcaggggatcgggctgataaaaaaaacggatctccaatggaaatccgttttttggtggctgctgttttaaggtgtaataagttatttcagccatgggctgaagtctttagcctaccgcttacttcacttccatacctttcgcttgcaggtctgcatggtaagaagagcgaacaaatgggccacaggctgcatgggtaaagcccatagccatggcttctgctttcatttcgtcaaactcggccgggctgacataacgttgtacgggtaaatgatggcggcttggttgcaagtattgccccagcgtcaacatcgtgaccccgtggcggcgtaaatcatgcatgacctcgacaatctcggcattggtttcgcccaagccgaccattaagccggatttagttgggatatctggatgtgcttctttgaagcgctcaagtaatttcagtgaccaatcgtagttcgcccctggacgaacctgccgataaacacgtggtacgttttccagattatggttaaatacatctggtggggttgcggtcagaatatcgagtgcgcgatccatacggccacggaaatcagggactaacgtttcaattttgatggttggattcttggcgcggatcgctgaaatacaatcggcaaaatgctgagcaccaccatcacgtaggtcatcacggtcaacggacgtgataacaacatagcgcagacccatgtcttggatcgtctgtgccagcttctctggctcattagcatccggtgtgactgggcgaccatgggcaacgtcacagaatgggcaacggcgggtacaaattgcaccaaggatcataaatgttgccgtaccgtggttaaagcactcagacaggttagggcaggaggcctcttcacaaaccgaatgcagaccattcttacgcattgcagctttgataccctgaatgcggctggaatcagtcggaagcttgatttttagccactcgggtttacgcaacagctcctgacgttcggtcaccacgttttttaccgggattaacgccattttgtctgcatcacggtattttacgccgcgttccatctgaatcggtttactcataatcgggcaggttccagttctgaatctctcaacttgagatttttcattaaattcaacgtaatgtagcgttcgttaaaaattatttgaaaattgtttaaaaattatatcatctttactctgtttcgttcagccattcacttttggcgcgatggtggcgttcacggtttcagttacatcgggcatatgagtcatttacaacacgcttgatgatgaatggcttgataataaatagtctgataatgaccacggctgcaattttgccgtcggataacctaattggcgggtaaattcgcgaaccaatacaggctgcacatccgcaacggtaacccctggttgtaatgcactgacttgtgtcatctgcatacccgcgtagccgcacggattaatgcgctggaacggttccagatccatcgcaatgttcaatgctaaaccgtgaaacgaacagcctcggcggatgcgtagccccagtgagcatattttctgttgttcaacatagacaccgggggcatctgggcgagcatgtgaatcaatattgaaatgggcgagagtctctatcaccgtattctcaatggcggtgactagctggcgtacaccgattttggcacgtttgagatcgaccatgacatacatcacttgctgtccggggccatggtaggtgacctgaccacccctatcactttgaataaccggaatatcacctggcatcaggacatgttcagcttttccagcctgaccctgagtaaagacgtgctgatgctcaaccaaccagatttcgtctggtgtggtatcagtgcgaaactcagtaaagttatgcatggcttgggatacgggtgcatagggttgtaaccctagctgacgtaaaatgatcttgtgttgttgcaagcgaggcatcatctggttacagaaatggtagcgccagtataccagccccgctgagtggggccactattttgacagttcaacgctataatttgatggctaaaggggataatttaaccccgaaaaaataaggcccggcacctgaataaacagggcgggccgtcattagcgcgttgtgaatggcttgatagtttatctataacccaaatggcttatatcgcctggactagagcaccatcttgaccaattcaagattgcccagttcttcatacagtgtttccacctgatcaatatgggtggctgtgatggtgatagacacggagtgatagttgcctttgctgctcggttttacctgcggggtatattcacccggagcatggcgctgtaccacttcaactacttggtcaaccagttgaggttcagcgatgcccatgaccttgtaggtaaaagagcaagggaactcaagtagttcgttcagtttcgttttcatgtgcgctcctgggctgtcgccggactgatagtggggtaatgataaaacgtatccggctataaaatcacaactcccgccggagcgggagtgacgtactgttcgccagataaggtcagcttatttgcaatataagattaatcacaatatggggccaatctactggctttcaagtctcttctgtttttcaagctagcggattagccgaaccagcggtggaacatcagtttgatgtaatccaccatacggctgaagaaaccaccttcttttacttcgttcatcaccaccaatgggcgctgatcgatggttttaccatctaactggaagttaatggttcccacaacttggtttttcgccagtggcgcatgaatttcaggtgtattcagcacatagctggctttcaggtctttcattcggccacgtggaatagtcagataagcatctttatctacacctaactgcacacgatcactatcgccaaaccagaccggttctgaggcaaactctttaccgactttcagcggcgcgacggtttcaaagaaacggaagccccaggtcagcagttttttactttcagtttcacggcccttaaaggtatggccgcctaaaacgactgaaatcaaacgcatctgcccatcagtcgctgatgcgaccagattataacctgctgcctcggtgtgaccggttttgatgccatctacgttcaaactggtgtcccacagtaaaccgttacggtttgtctggcggatattgttgaaggtaaactctttctctttatagatagcatactcatctggcacatcacggatcagggcttgaccaatcaatgccatatcgcgtgcagagctgaactggccttccgcatctaaaccgtgaacagttttgaagtgggtattttgtaagcccagcgccttaacatagttgttcatcaggttaacgaatgagtcctgactccccgcgacataatcggccatcgcgacgcaggcatcgttacccgattgtaagttgataccacgggtcagtttagacaccggcacacggtcgcccggtttcagaaacattagggaggagcctttaaattccgggttaccggtagcccaggcatctttacccacggtgaccatgtcatcagccccgattttccctgatttaatcgcctggccgatgacgtagctggtcatcattttggtcaagctggctgggttgcggcgcgtatccgcgttcatttccgccaatactttcccggagttgtaatcaattaggatgtaggcttctgcgtcgatctgcggtacgccggggatcatggttttcagattgacgtcatcagcgttagcagcgctcatgacaataacagtgccgagcgctaggctcttgataatgcgagaggtaattacatatttcatgatcaggacaacaacatccgtgggagtaagttaagaacatgccacactatagcagatgagatcccggcagacatccgacaatctccttgccctgtggcgtttatacccgtcatatttcaagtcgcctgtacgttggcggccttccttcaccccagtcactgatttgccattggccagacatcttgccgttggccttacataagttgaccttacataaatagcgcctgggattagctgaattgctgccttcctgccactcgacgtatttagggtatatatttacgggaaggggagtagccccttatttcacccaaacagttttaaccgtaacaccctgtttgcacaggcggttacggttatttttattagtcagtgtctaaattgctacaaggcgtgtccgccttagggcgctgccacgataaaggattgctgctgtgcttcatttgagaggcgttgttgcagatcaaccgcttgttgacgatgactgaaaggccctagctgaacacggtatatgctgccactgttggacactttacccggaacaccaaaacgttggcttaggctttgttgccaagactgtgctcgctgagcatcgctcagtgcaccgacctgaacgacataaccgcctgatatcgcgctggatgttggtgttgtagtgaccgggccgggattggcgaccacagggggggtgactggcgctgaatctatcactggctccgagctttccagcacacccgcagggactggcgtgggcgctcttaggaaaccactactttgtgatgcgacgggttgcgtggcatcagtacccgataactggctgttatcaatcgcctgtacagcggcaccggttgctggggcatcttgttgcatcggcgtacccatcccgcttgatgttaggtccgggcggctgggtaacgcataactttgtttcgcgatggtggtgcctaccataccagggccagacagcgagccatcaggggcgacattgataaaatctatcttcaccttggtattgttagaaatatttaagcgatctgcagctgctctggataaatcaatcacacggcccggcgtgtaggggccgcgatcattcacacgaaccacaatttggcggccattactgacgttagttacccggacatagcttgggattggcagagtagggtgagcggcggtcaaggcattgggatcaaaaatttctccggttgccgtggtattgccacgtgcctcttcaccatatgaagaagcaagccctatctgagagaaattctgcggatctttgataatacggtaggactggccattaactttataatcctgattaacgttaggattaaaaggttcgtagcgcggttctgccccgccaatttcttcaactgggccgctgtaggtttgttgtacttgttgctggggggccggaggctgatcaatacatgctgatagcagcacacttgcgatgccgacccaaagccattccttacgcattgcccacctctataaattcttagataacatttttcgatgagtatgtatcgacatcacgataccaaacccggccatcagaactactagcgccgagcctccataactgactaagggcaaaggtacgccaaccaccggtaaaatgccactgaccatacctatgttaacaaatacatacacaaagagtatcagcatcaacccgccaaccatgacccggccgaaggtggtttgtgcatttgcagcaatgaccaagccgcgcatgatcaaacataaatagaggcctaataagaccagcacaccgattaaaccgagctcttcagccaatacggcaaaaatgaagtcagtatggcgttcaggtaagaactctagctgtgactgagtgccgtgcaaccagccttttccagataaaccaccagagccaatcgcaattttagactgaataatatggtaacccgcaccgagcggatcgctttctggatccaacagcatcatgacgcgatcacgttgataaccatgcatcaggaagaaccagagaatggggataaacccggccaacagtacaaccgcaaccccaattaagcgccagctcatacccgaaaggaacaacacaaacaggccggaggccgcaaccagaattgatgttcccagatcgggttgagcagcaaccaacaaggtggggatgaaaattaaaatcagtgcgatgccggtatttttcagtgagggtggacaaacatcgcggttcataaagcgtgcaaccatcagggggacggcaatcttagcgatttcagaaggctgaaagcggataaaacctaagtccaaccagcgttgagcgcctttgcttatctgcccaaaggcatcgaccagtatcagtaatatgacacaaacaaaatagagatagggggcccagctttcatacacccgtggcgggatctgtgccatgaccaacatgacaatcaagcccatagcaatttggccaactttgcgttccatcatgccaatatcttgcccactggcactccacatcacaaaggcgctataagccagcagcgccaagatgcaaatcagaaacggtaggtcgatgtgtagtttgtaccacaacgagcctttttgttgattatcagtcatgagttaccttaatccgctccaacgctatttattttcaacgtgacctgtcttaacgtgacttgtcttaacgtaacctgtcttaacgtaacctgtcttaacgtgatcggcttcaatgcgacctatttcaactcaacgggcatcaacgattagtttgcttttagtctgcttcaactaatctgtttcaactaatctgcttcaacgccaggaggcagaggaaccgcatccggtaattcagtattattatcgcccaacaagatatggtcgaggatctgacgggtaatggtccctaccgcaggccccgcgcctccattttccaagattattgcaacggataccgtagggttctcatagggagcaaacgcaaccattaacttatggtcgcgcaggtgttctgccactttactggcattataggtttcataactgtaaacctgtgcggtacccgatttcgccgctgccttataaggtgtaccttcaaaaaacttgcggccagtaccgtttgggcggttcgctacgccatacatgccgtctttagcaatttcccaatagccagaattgatactcccaatctgcatactgtcttcctgcttataaggcactaagacgccatcaatccgggtgctttgcaacaggtgaggtgtcttgactgtgccatcattaatcagggtcattaaggctttagccatctggattggcgtcgcagtccaataaccctggccaatacctaccggaatggtatcaccctgataccaaggctttttatggcgcttttgcttccactcgcgtgttggcattaaacccgcacgctcttcggataaatcaatgccagtatattcaccgtacccgaatttgctcatccaagatgataagcgatcaatgcccatatcataggcgacttggtagaagaaggtatctgccgattcttccagtgctttggtgacgttcaggcggccatggccccattttttccagtcacggtagcgcttttccgaaccgggcagttgccaccaaccaggatcgaacaggctggtgtttttggtgataaccccggcactcagtgctgacactgcgatgtacggtttcacggttgatgccggtggataaacgccttgggttgcccgattgattaaggggcggttcgtatcgttaagcaacccttgataatctttgttggagatgccgtcgacaaacaggttcgggtcatagcttgggtttgataccaaggcaaggatcccgccggtgcgtgggtctgtgacgacgaccgcagcacggctgccactgagtaacttctcgatatagatttgtagactcagatcgagagtcagataaatatctttacctgcttgtggcggttgctcatgtaattggcggattacccggcctcggttattgacttcaacttcttcataaccagttttgccatgtaaggtggattcataatagcgttcaatacccaacttaccgatatcgtgggtcgcagcataattgggaagaatgccttctttatccaaccgttcgacatctttatcgttaattttagagacatagccaatcacgtgggtcagggcggagccatacgggtagaagcgacgttgatagcctttgacttcaattccggggaagcggaattgattcactgcaaaacgggcgacttgcacctcggtcaacggtgttttaacggcaatagaggtaaagcgacgtgagcgtttgcgctctttttcaaagttagcgatatcgtcgtcagtcagatccactattgggcgcagcgcattgagggtggctgacaagttttcgatcttttccggcatcaactctaattgatagatggtgcggtttaatgccagtggtgtgccatttctgtcaaatatcatgccacggctaggggcgataggaaccagtttgatgcggttgtcgttggagcgggtgctgtaatcgtcgaaacggactatttgcaaattatagaggttagcaaccagtaccccgctcagtagcaggatacccagaaaagccactacggcgcggcggacaaacagggctgattcagccgaatagtcgcgaaaagggttaggttcttttttcattccgcagcttacgtcattttgctcaaaaccagcatcttactcagagccagagccatcacttgattcagtttcatcgcccgtttattcccggtgataaggatgattggtcgtaatactccaggcacgatagaggctttcagccactaaaacacgcactaaaggatgaggtagcgttaacggagagagcgaccaactctgctctgcggcggctttacaggccggggctaacccctccggcccgccaatcagcaggcttacatcacggccatcctgcttccagcgttctaattgttgagctaattgcggggtctcccagggtgtccctgggatatccagcgtgacaatacggttatttttccctaccgcagctagcatcagctcgccttctttttccagaatgcgtttgatatcggcatttttgccccgtttacccgcaggtatttctgccagctcgaagggcatatctttgggaaagcggcgcagatattcgataaaacctgtctgcacccagtctggcattttcgtgccgacggctaccagttgcagtttcaccgcttagctccagagtttttccagttcgtacatacggcggctttcttcttgcatcacatgcacaatcacttcgccgagatcaacgacaatccagtctgagacgccttggccttcaatgcccagcggtatcatgcccgccgcgcgtgactcttggaccacattatctgccagcgccataacatggcgggttgatgtgccggtacagataatcatgcagtcagtaatactggatttaccctgaacatccagagcgataatgtcttggcctttcaaatcatcgagtttgtcgataacaaattcttggagcgctttaccttgcaaaggttccccctcgggtcgtttttgttcgtaacgttttcactaaggtgccgttccacccgatttctcgtaggatggcgaccgttaatgaacggctatgatgtatttatcggcaggatgccgctgaaagcccgccgttcgtgcttatttcacaggggttgtcagcgaatacctaaaatttagcggcggagtataccacgggactttccgtggtgatagaaaccctcagccgcgatataaaccttgtaactcaatatatcgctggacagcttgggggagaaggtcatcgcaactctcgccgttatgacgccgacgacggatatcggtagcagagatatctaacaacggcgtatccgccaggtagattgcgccatgtggacgttgactcaatgcctgtggatccatgaccttatggctctctaaccattgctgcaactccggtgtttccaatgactgtgaataacctggccgggcgcaaactaataaatggcacacatccagcaacgcctgccagcggtgccatttatgcagcgataataatgaatcttgcccaatgataaacgctaaaggctgttctgcaccacgttctttacgcagtgcctccagtgtctcgatggtaaatgatgggctgtcacgtaataattcacgagaatcaacgctaaacagtgggttcccagccaccgccagttccaccattttaagccgctgttgtgcattggcttcgggttgagggcgatggggaggcacatgattaggtaataaaataatgtgttgcagcccgacttgctgagctaatgcttcaaccggtttcagatgaccgtaatgaatgggatcaaaagtaccgccgaataaggcatacagggaatgatccgaggatttaatgggcatcaaaaaagctctcaggtaatgtttttccacacatcagcatagatagcgtttctaactcaggccagattgattgaccataatcctgtttcagccggatttccatctgtgtgagcagatgaaccgcctgttgcagttgctgaagggagagccgttgcagtgcctgagtcatcatgggccgccggttctgccaaattttgtgttgatcgaataatgcgcgcaatggaacttgttccatctgacgtttgagcgctaacagcaggagcagttcacgttgtacggtacgcagtaaaataacgggttcactgtcttcttgctgtaattgctgcaaaatatgccaagcccgcttgctcttccccatcaacaaggcatcaagccaatggtatggtgtgaaatgcgcagcgtcgttgacggcttgttctactttaggcagggttaacttaccgtcggggtagagcagcgagagccgttctaacgcctgagataaggccagcaagttaccttcatagcagtagcaaagtaattgaatggcggcatcgtctacgttcaagttgaggctcttggcgcgagcgctcacccagcggggaagctgggcctgttctggtgtctggcaactgacaaataccccatttttactgagagctttaaaccaggcgctgttctcttgcgctttggtcaacttattcgcccgcaatatcaataaaatgtctgggtgtaacaggctagataatttaaccaactgctcgctaattggcgcggtcagcccactgtctgggaaactcagcagcagtgtctggcggctggcgaacaaactcagtgcctggcaaaggctaaaaatatgctcccattcggtgtgcgcgtccaacgcaaagctgaaatgctcagtgaaatcgtgctgcgatgccacccgacgaatgtggtcctgactttcctgtagcaacaagggttcattgccacacaatagataacaagcgcgtagcccctcatggagctgcgcgacaagttgttcagggtaaatccggatcatttggctgaggtactgacggcaggttcgccgagagtggtttcattgacggctgtcggggttgagccctgagccgcgttggcatcactcaccggtttatcaccatttttctgcgtgtttttaacttctgccgcatgtaccgtcagtaactgacgcactaactgctgggcggcttgctcacgcatttcttgacgaagcacctcggcttcagcctctttggctaacgccgttaacgggttatcaaagaatgtgcggaacacattgacctgcaatgggtaaatatcatggcccggaatcaacacctgcgcctgtacatgtagcactaactgattctcggccgcgacaccgttacggaagatagacactgtctcttggctttcggatgagccgatgatccgcagcgtcggtatatctttacgcatggcgtcatcaacaatagtcacgttatttaaacgtagttgttgacgtatagacctggctaacgggccatagggatcgctgctctccagcaataatttttgcaactcagttggcacctgagtggtgccccgcagattaaaaccgcagccagcggtgaccagcaccgccaaccccagcaacaacgtcagaatacgatgtcgcacaacgcctccttgacttaacccacaaccagattaagcaatttgccagggacatagatgactttacgtacagtaacgccatccagatatttagccaccaagtgctcctgaccagcgcgttcacggacttgctgttcagtggcatcggcgggcactgtaattctgccacgcactttgccattgacctgtacgaccactaatttagagtcttcaaccatcgcttgttcatcagcaattggccacggcgcagtatcgatatcgccttctccacccaaagcttgccacaaactgaagcagacgtgaggggtgaatggataaagcatccggactaccgccagtaaagcttcttgcatcagcgcgcggtcttgctccgtttcctgaggtgcacggcccagcttgttcatcaactccatcacagcagcaattgccgtgttgaaggtttgacggcggccaacatcatcggtcactttcgcaatggttttatgcaggtcgcgacgcagggatttctgttcttcagtcaggctggcaatatccagtggcttcactgcacctttcgcggtgtgatcaaaggccagacgccaaacacgcttcaggaagcggttagccccttcaacgcccgactcctgccattccagcgtcatttctgctggtgaggcaaacatcataaacagacgtacggtatccgcgccgtatttttctaccatgacttgcgggtcgataccgttgtttttcgatttcgacattttactcatgccggcgtacaccagctcatggccttccgcatctacagctttaacgatacggcctttgtcatcacgttcgacaatcgcatcgaccggtgaaacccaaatacgctcaccgttattaccggtgtaatagaaggcgtcagccagtaccatcccctgacataacaggcgtttggcgggttcatcggagtccaccagaccggcgtcacgcagtaatttgtggaagaagcggaaatacatcagatgcataatggcatgttcaatgcccccaacatattgatcgacaggtaaccagtagttagcggctgcggggtccagcataccatcatcatattgcgggcaggtgtagcgcgcgtaataccaagatgattccataaaggtatcgaaggtatcggtttcacgcagacccggaataccgttaacggtggttttagcccactcaggatcggccttgatcgggctggaaataccgtccattaccacatcttctggcaggataaccggcagttgatcttctggggtaggaacgacagtcccatcttccaacgtaaccattgggatcggggcaccccaataacgctggcgagaaacaccccagtcacgcagacgatagtttactttgcgctgcccaacaccgagtgcgaccagtttatcggcaatggcattaaaaccatcttcatgattcaggccatcaaactcaccagagttaaacagcgtgcctttctcggtcatggcttcctgactcaagtctggctcactgccatccgcggccaaaataaccggtttgattggcaggttatatttggtggcaaattcccagtcacgtgcatcgtggcccggaacggccatcactgcgccagtaccgtaatccatcaagacaaagttagcggcccagataggcagtttctcgccagttaatggatggatggcatacagacccgtcgccatgccttttttctccatggttgccatttcagcttcggcaaccttggtattacggcattcagcaacgaaatcagccagggccggattagtcgccgccgcttgcaatgacaaaggatgaccagctgcaaccgctacgtaggtcacgcccataaaggtgtctggccgggtggtataaacagacagtttctcttcgctatccacgacgtcgaaaacgatatcgaccccttcagagcggccaatccagttacgttgcatggttttcacctgctctggccagctttccagcgtgtccagatcgttgagcaactgctcagcgtaatcggtgattttgataaaccactgcgggatctctttacgttcaactttggtgtcacaacgccagcagcagccgtcaatgacctgctcgttagccagcacagtgagatcgtgtggacaccagttaaccgcagaggtcttcttgtagaccattcctttttcatacaacttggtgaagaaccactgctcccaacgataataatcaggtttgcaggtggcaatttctcgatcccagtcatagccgaagcccagtaatttcaactggttcttcatgtattcgatgttgtcgtaagtccaaggtgcgggggcggtattgttttttaccgcagccccttcagcgggcaggccaaacgcatcccagccaattggctgcaagacgtttttgcccaacatacgctggtaacgagagataacgtcgccaatggtgtaattacgaacgtgccccatatgcaggcgtcctgaagggtatggcagcatagataggcaataatatttttctttgctggcgtcttcagtgactttaaaggtttgcttctcttgccagtgaagctgtacttgcgtttcgatatcttctgggcggtattgctcttgcatggcggccggaggtcctatagtgaaaaacagctacgcctgtagcatcatctgtttcatatcataaagagagatccgcatagcatagctgataagcggcaggcgcaacaacactcagcaccccatggaaggatttttctgcgcagtgaatggcataaatcaccaaagtgaggggggccacaacctgatgacgacatgacttcagttatttacgactagaataatttataattgaacatcataaccgtggatcgaggagacagtatgaacaagatagctcagtactaccgtgagttagtggcatcgctgaccgaacgcttgaaaaatggtgaacgtgatattgatcaactggtggaaagcgccgaacggcggttgcatacagttgaagagttaacccgcaacgatgtcgagcagattgttcaggcagtacgacgtgacttggaggagtttgcccgtagctatgaagagagcaaggaagagtttcgcgatagcgtattcatgagagtgattaaagaaagtctgtggcaggagctggctgatatcacagataaaacacagctagagtggcgcgaggtctttaaagacgtaagtcaccatggggtttatcacagtggtgaagttgttgggctggggaatttggtctgcgaaaaatgccattatcacctggctttctatacgccggaagtcctccccgtctgccctaaatgtgggcatgaccagtttactcgccgcccattccagccatgataggggaagtagcgccactgcggtcgccaaaagaacagagtaagaaataaggaaaaagtaaaaaatcagaaaagataagaagtcataaaaaataaaagtgacctcccctacaaacgcaggggaggagaacgaattaatgcaagattttagccaggaagtccttggcgcggtcagatttaggattattaaagaaatcatctttatcgctgtcttcgacaatcttcccttcatccatgaaaataacccggttagccactttgcgggcgaagcccatttcgtgggttaccaccatcatggtcattccctccagcgccagtttgaccatgacatccagcacttcattgatcatttctggatcaagcgctgaggttggttcatcaaacagcatagcgatagggtccatgcaaagagcgcgggcaatcgctacccgttgctgttggccgccagataattgggatggatatttatctacatgggtagaaagaccgacacgctctaataatttcaagcctttctcaagggcttctgccttatcgcgtttgagcactttgatttgcgccagtgtcaggttttcaatgatcgagaggtgtgggaatagctcaaaatgttggaacaccataccaaccttggaacgcagttgcgccagattagtgcccttatcattaacagcaatcccattaaccgtaatattgccttcttggataggttctaatccattcaccactttaattaaggttgatttgcctgagcctgaaggaccacaaacgacgactacctcaccttttttgacttcagtagtacagtcagccagcacctgaaattgaccataccatttagaaacattcttcagggaaatcatcaaacagtccttttcttcaaatagttaaccagcattgacgcggaaatactgataacgaaataaactaaaccggcaaacagtaccatttcgacctgcgtgccgtcccgttcgccgatggtggtggctgtacggaagaaatcggccaggctaaggacatataccagtgacgtatcctgaaataatactatcccctgagttaacagtagcggcaccatggcccggaaagcttgtggcaggataaccagtctcattgattgaccctgagtcatccctaacgccaatgccgcagaggattgcccacgagaaatactttggatcccggcccggataatttccgagtaataggcggcttcgaacagcgaaaaggctaccatggctgagatcaaccgaatatcagtttttggtgataagcccagcacattttgtaagaagcctggcaccactaaataaaaccacaacagcaccatgaccaacggaatagagcggaacacgttaacataagcagttgcaaaccagctgatggctttaatcggtgacaggcgcatcactgccaaaattgttccccagaggatcccgaacacaatggcgatgagggttattttgacagttacaatcaagccttgcagcagatagggcaggctgggggcgatggaactccaatcaaattcgtacattatttactccccagattgccgggtaattgcactttcttttcaactaagcgcattaacagcatgatcacggcattgatcagcacataacctagggtgatggcggtgaaggattcataggcatgcgctgaataatccagcaatttacccgcttgtgccgccatttcgactagcccgatggttgaggcaattgcggagttttttaccagattgagcatttctgaggtcatcgggggaataatcacccgatatgcattgggcagtaaaacatagcggtaagtctgtgtgagggtgagccccattgccaggcccgctgctttttgaccacgaggcagtgattgaattcctgcgcgaacctgttcacaaacccgcgccgcagtgaataatccaaggcaaatcatagatgagaggaagaactgtatattgggtgccagttcacttttaaaccatgtgccaaggttcactggcaacagttcgggaaccaccagataccaggtaaaaaattgcacgatcagtggtacgttacgaaacaattcaacgtaacaagcccctattcctgaaaggattcggttgggtaccgttcttaaaataccaaacagtgaaccgacgaagaaggcgatcacccaagcacataatgataatgcgaccgtgacctgaaagccggaccaaatccaaccgagataggtggtattgccgaaaggggctggctgtaaaaaaatgccccagttccagtctattgccataacaaactcccttaaaggatggataagccaccctgatgactgatgattcaataccttcggctcccgagggttgacaaaaaaatgcggggtggggaacgaccaccccgcatcctgtctaccaataggccatcatcaatcggtagggcaggtatgacccgccctgattattattgttagttcaacgccttatcgttaggtgctttgaacagcgccttcatttcgtcagagagtgcgaaattcatattaagatttttaggcggaattgggtttttgaaccagcggtcaaatgacttttcagctacgcccgtggtttgcgctgttgcaatcgttttatctaataacgctttaaaggccgggtcattcttacgcatcatgcaaccgtaagcttcctcagactgcggtgtcccgacaatactccattcatcaggtttcttggcttttgcccgttcaccggctaacagcgcatcatccatcataaaggcgaccgcgcggccactttccaaggtacggaaagagtcaccgtgatcttttgcactgatgatgcgcatattcatgttgtctttttcattcagcttgttgagcagtacttcagatgttgtaccggaagtaaccacaacggctttacctgccaaatctttgaagtctttgacttcagagtcttttttggtgagtaaacgggtgccgacgacaaaaatggtatttgagaatgccgcttgctgctgacgttccagattattggtcgtagagccgcactcgaaatcaaaggtaccgttttgcagtaatgggatacggttctgtgacgtgatggggatcaatttcacctctaaatttggcgcattaagttctttcctaatggcatccacgatgaggttggagtaatcctgcgagtagcctacaactttctgctgattatcataataagagaatggaacagaagattcacggtggcccacaacgataacaccgttgtttttaaccttttgcaacgtatcaatagccgtatctgccttcgctgttgcatcttctgcttgagccacgctacttgtcatccctgctaacagtagcactaacgccaatttacgcatttgcatggtccaactcctttgctgttgttttcttgcttaatgttgtgatgtgaaaacacatggctatgttgaaacgttcttatattaaaacgctcttatgttaaataacggtaacaataaaatcggtttgttggctttgctggtgtaatcaccgccgttttatcggtgagtattcgattttcgctgctatttgtatcagattatctttaaaaaatagcttattgttatgcaaatgatgaataattgtttgttttttgagacacgaatcgcaccaaatagaggcagtaaagcagccatgcacttccgtagtgcggacaaggccctataaatgtgcaagcgaataaacgtgcaacggagttagaaacacactaaccacggccagagtcctaacttgctaagcgattaccgttgctggctcatactatgagtagaaataatgcaaggtttgtgccagtagggggagaactaagcggaatatagccctggagtgcagggctatcaggtacaaatagaatgagtggaataacagatgagaaaaacagacgttatctgtgactggaagcactaagttgttggttaatggctctcaatttttataaccatcaatatttgtaactatcaatgtttttaactataaataattataaattgtaactatcgatgcttatagcaaattagcccgtttttataacaggttagccaatgtttatggcaagttgaccaaggcttatcatcaattagtactgatcataaattagtgcttatcagagcgcccccggattgcgcagtacagggtaaaggcgcccaaaaccagagtaataatccacattggccatgagccaaaacgggcatatggcgtgataccggtggttggggtgaccttgacctctagaacctgttgagtgaactgtgggatctgcgccagaatttcaccacttgggccaatagcggcagtaatgccattattggtgctgcgcagtagcgggcggcccagctccagtgcgcgcatacgtgccatttggaaatgttgccacggcccaatggagtgaccaaaccaggcatcattggagatagtcagtagaaaatctgtttcagggcggaagttatcccgtacttgctggcccaagacgatttcataacaaatagccgccgtgaggttaaatccagcgatagtgagtgggggttgaacataatcaccccggttaaatgaagacatgggtaaattaaataacggagccagcgggcgcagtagggactcgagcggtacgtactcaccgaagggcaccaagtgatgtttgctataacggttgcgggtcgggtattgataggtatctttatcgcctaacacaatgatgctgttaaagaattgatacccttgcccctcgggttgccgcttggcatctacaatgccggtgatcaggctgctatgatttgcccgcatcaggccatctatcattgtcaggaaggtgttctgatcggtttcaatatcgggaatagctgattctggccagataataatgggggctttgcccataaatggccgggtttcatcaagataaatttgcaatgtggtgatcagggctttgggatcccacttcattgactgagcaatattgccttgtaccatggcgatattgactgctctttcaggctctggtgtgaaccactgtatttggcgcagtggccagggcagcagcagtaaggccagcgcgataattgctgcgacaatacgacgttgatagcaggcgtagaccagcaagccactgatagccatcaagataaatgtgatgccatcaacaccgaggaggggagctatccctcgcagagggccgttaatttggctgtagccgaattgtaaccacgggaaacccgttaatacccagccacgtaggaattcagttaattgccagagtaccggggccgcaatcgcgagccgccaccaggtagccttagggcacaggcgggctaataaaccggcgaatagcatggtgtagagtgataaatatgctgctagcaagatgacgaggacgatattgattgccgttggcatacccccaaattcggagatgctgacatacacccagttgatgccactgccaaatagccccatcccccaacaaaaaccaatgaaggtggcttgtttggtggtgcggttcaacgtcagactgagcaaaccgaatagtgaaacaatggcggcaggccaatgatcaaacggcgagtaagcaagcgtgccacaggcaccaaaaaatagcgccagtagggcgcgaacccactggcgttggaggaatagagcaatagacatcaagaatttattcttccagtttaggttgcggagcatcatccgggatttttacatgaacctgaatgatacgtcgactatctgccatggcaactttaaataagtaaccttcaatttcaatcgtttcaccacgggcaggtaagtggccaaaggcttgcatcactaaaccaccgatggtgtctacttcatcgtcgctgaaatgggtattgaacacttcattgaaatcttcaatttgcgttagcgcacggatggtataggtgtgccggctgagttgacggacatctctgtcttcttcatcgtcatactcatcttcaatttcgccaacgatcagctcaagaatgtcttcaatggttactaagcctgaaacgccaccaaattcatcaataacaatggccatgtgatagcgctgtgagcggaactctttgagcatccggtcaacacgcttactttccggcacgacaatcgccgtccgtaaaactttatcaatactgaatggttcagaatctgtgcgcataaacggcagcagatctttggccatcagaataccttcgatatgatctttatcttcgctgatcaccggaaagcgggagtgagcggattcaataatcacatccagacactcatccagcgtttgattacgctttaatgtgaccatctgagaacgtgggatcataatatcccgcacgcgctgctcggcaatatccatcacgccttccagcatgtctcgggtatcgggatcgatcagatcgttttgttcagaatcacggataagctcaaccaaatcgccacggtttttgggttcaccgtggaagagctggttaaggataagagtaaagaaccctttcttgggactggggctatcgctgttttgtgaatggtcgtcgctcatggcgttttagttaaatttactcatgttagtgatgataatgtcagcagcggtagattcacgctactgacggtttgggccaattttaatagggcaattaatgtgccctttatgactggcttagtcggggtctttctctgaaatatacgggtctgggtaacccaaaccgtgcatgatttcagtctcgatcaactccatttcttctgcttcatcatcgtcgatgtggtcataccctagcagatggagactgccgtgaacaaccatatgcgcccaatgagcgagcagcgccttttcctgttcaatggcttctttctcaacgacctgacggcaaataatcaaatcgcctaataatggcaactcgatttcaggtggggcttcgaaaggaaaagacaatacgttagtcgatttatctttaccacgataagtcagatttagatcatgactttcagcctcatcaaccagccggatggtcacctcagatacgggctgaaatagcggtaatacagcctccagccagcgttgaaaatcaccttctgtgggtaaaccctggctatcggcacaggcaatttgtaaatcgagaataacctggctcacggagcctcctgctctagcggggtatgggattcccgctgacgttgttcaataatggcatctttacgttgctgttcagccgcttcccacgcttcgtaggcaataacaatgcgtgcgacaaccgggtggcgcacgacgtcttcgctatggaagaagttaaaactcagttcttcgacgtcagacagtacctcaatggcatggcgcaggcctgatttctggtggcgtggtaaatcgatttgtgtcacatcaccggtaatcaccgccttagaattgaagccaatgcgggtcaggaacattttcatctgttcgatggtggtgttctggctctcatctaaaataataaacgcgtcattcagtgttcggccacgcatatacgctagcggagccacttcaatcacattgcgttcaatcagtttctcaacccgctcaaagcccagcatttcaaataatgcgtcataaagcgggcgcagataggggtcaactttctggctgaggtcaccgggtaagaagcccagtttttcaccggcttcaacggctggacgcgtcagtaagatacggcgtacattctggcgctccagcgcatcaaccgctgcggccaccgccaaataggttttacctgtacctgcggggccaataccgaaagtaatatcgtgatctaaaatattggcgacgtactgcgcttgattcggagtacggggttttaccatcccacgcttagtctgaatattgaccgctttaccataatcgggcacgctttcagcggattgttccagcactcggctctcttttaccgccaggtggatttgttctggatcgatatcagggataacaccacgaattggcgcagtatcaacatataggtggcgcagaatatctgccgctgcaacaacgcagatattcttaccgattaacctgaagcgattgtcacggcgattaatctcaatacctaaccggcgttccaactgcttgatgttgtcatcaaagggaccgcacaggcttagcaggcgctgattatctgcaggttccagcaagatttcttgtgtcactacgtgcaaactgtttttctgggtcactgagttcctctgggtcatatcgggccggtttagggtcactacgttaggtacattattgactcatataacctcaatcatacaggtcatttgaggattattcatggtgaatggtactgacgcaagtctgtcgcttattaatctgagcttgaattgcctttattcaaatggaggtaacaaggcggcgcaacctaaaatattcggatctgcgtagcggcccgctaaaataaaacaggcactgacaatgcagtgcctcgttacgcgggcgggatcaagtaaacctgtcagatcaatgatgttaggccgggcgttaccaaaatggatgttggttaaggctgataaatacctacaccaatttcattttctttacgggtgcgagcaatcaccgattgcggtgactcgtgggttcgcaggtccatctgatcttctgtacgcagtaaaatgccgcgcagtgaactggcataaacgttaacaatttcgacatcaacgaatttaccaatcatgtcgggtgaaccctcaaagttcacgacgcggttgttttccgtacgcccggccagttccatgacatttttgcgagaggtcccctccaccaaaacacgctgtactgtccctaccatcttacggctaatttccatcgcctgttggctaatgcgttgttgcaggatatgtagccgctgttttttctcctcttcggacacattgtcgggtaaatcagccgctggtgtgccgggacgcggggagtaaataaagctgtagctggtatcaaaatgaatatctgcgaccagtttcatggtctgttcaaaatcctgctgggtttcaccagggaagccgacaataaaatcagaacttatctggatatcagggcgcgcctgacgcagtttgcggatgatggctttgtattccagggcggtatgggcacgcttcatcatggtcaaaatacggtcagaaccgctttgtaccggcaaatgcaggaagctcaccaattcaggcgtatcgcgataaacatcaatgatatcgtcagtaaactcaatggggtggctggtggtaaatcgtatcctatcgataccatcaatggccgcaaccaaacgcaacagctcggcaaaactacagatatcgccatcgtaggttgccccgcggtaggcgttaacattctggccgagtaagttgacttcacgtacgccttgagcggctaactgggcgatttcaaaaagaatgtcatcgcttggacggctgacttcctcgcctcgggtgtagggtacgacacagaatgtacaatatttattgcagccttccatgatcgaaacaaacgcagttgggccttcagcccgtggttctggcaaacggtcaaatttttcaatttcgggaaaactgatatccacgacagggctattcgttccttgcacgtggttaatcatttccggtaaacgatgcagcgtttgtggcccgaagatgacatcgacacagggggcgcgctggcgcaattgttcaccttcctgtgacgccacgcaaccaccgaccccaataatcaactgcgggtttttctctttcaataatttccattgccctagcaggctgaatactttttcctgtgctttttcccggatagaacaggtatttagcagcagtaaatccgcttcttccgggatggtggttaactggtagccatgggtactggccaagagatctgccattttagatgaatcgtattcattcatctggcaaccccaggttttgatatgcagttttttagtcatcgggttattcatcatcaaaatcacctcgttccgtgcggtactccgttgtggtagataatctccgttgtagtagagagtcgcaaaggcttcgtcgttagggagcattgtagtcatttgcctctgcgatgaccaccgcagaaccgttgagttattctgttgagtgataaaaaatccgttacactgcggttagacaaaaccttgctaatgcaagaagtacattcacttttaaaacatagaaaaaatgaacaaatcgcaaccaaattatgatgttgtggtcgttggcggtggcatggtaggtgctgcggcggcgttggggctggcacaaattggctggtcggtggcgttactggaacatgatgctcctgcaccgtttgacaaggatagcgtaccggatttgcgggtttctgctcttggttgtacttcggtggcgttattgaagcagcttggtgcttggcctcaagtacaacagatgcgttatgcaccttatcgtcgcttggaaacctgggaacaaccggggtcacaggtggtgtttgatgcggcctcgctgtctttacctgagctgggctttatggtcgagaaccggattttgcagcttgctctatggcaacagtttgctgaatgccccaatttgacgctgttgtgcccgtcacggctacaaagcatggttcgaatagatgactactggaaagtcacattgaatgaacaggaggagatacagggccgtttagtgataggtgccgatggtgcgaactcgttggtgaggcgtttggcggggataggcaccagcggttggcagtatcgccagtcttgcatgctgatcaccgtagataccgatgtcatgcagcaggatacgacatggcaacaattcttcccgaccgggccgcgtgctttcctacccctgtttgatcactgggcatcattggtttggtacgacagccctcaacgtattcgtcagcttcaggcgatgtcgatggcacaactgagccaggaaatcgcagccttcttcccatctcgtttgggggctgtcaaggcgattgccgctggcgctttcccgctggttcgtcgccatgcgcagcagtacgtaaaaccggggttggtattattgggagatgccgctcataccatcaatccattggctgggcagggggtcaacttgggataccgtgatgttgacgcattgctggaggtgcttagtcaggcccgtgagttggctgaaccttggcacagtgagcaggttttactgcgttaccaacgtcgccgccgcaccgataatctcatgatgcaaagtggcatggatctgttttacacggcctttagtaatgatctgccggcggttaagtttgcacgtaatctggcgttgatggtggcccagcgtgctgggaagctgaaagaacatgcattgaggtatgcgttggggttgtagggatattttgtttttttagggaaaatcggcgtaggctttggtgatgggattcggttgatttggtgattgttcggttgtgatggcttcgcggcttatctaacctccgatgccaaaggggccacaagcgtgcactgaaccccaaaagttggacacctgatttttactgcctttctgcctgagcccggtattctgccgggctcatcattccgctgacggaccgccgtgttccgctcctgctcttgtcatctgaacaacaagacggtatctcaagaatgccgcgcatcctatcttcattcttcacgcggctcaaatgtactttgagcgtcaacaaccggttaaaaagcaaatgtgctttgagcgtcaacaaccaatgaaaaagcaaaaagcccgccgaagcgagcttttctaaatttggctggggtacgaggattcgaacctcggaatgctggaatcagaatccagtgccttaccgcttggcgataccccaaaagatggtggctacgacgggaatcgaacctgtgaccccagcattatgagtgctgtgctctaaccagctgagctacgtagccatctttaaatcttttttgcttaaaagattgtatggctgggataccaggattcgaacctgggaatgccaggatcaaaacctggtgccttaccgcttggcgatatcccaactgatatacaattcttttgttgcatcactctatttttgtctacagctacagctttatgcctacagcaactcatcaaaaaagatggctgggataccaggattcgaacctgggaatgccaggatcaaaacctggtgccttaccgcttggcgatatcccatccgctgtgacaaaccgatgaacaaataatggtgcgggaggcgagacttgaactcgcacaccttgcggcgctagaacctaaatctagtgcgtctaccaatttcgccactcccgcaaaaagatggtggctacgacgggaatcgaacctgtgaccccagcattatgagtgctgtgctctaaccagctgagctacgtagccatcttttttcgcattaccttcatcggcgttgcggggcgcattatgcgtatatggccgaattgcgtcaactaattttttcccgaaaaagcgctgaaggggttcatttgtttggcttgtgaacagtctggcgattaaagcagcagttatggtgattgattgttgaatttgccaacaaaaataatctttggcggatatcactcattggcaacgaagaggttggcctttggtcggttgggtgacgtaaaaaaacaaggccgccccagaggcgaccttgctatctattctctattatcccgtctctcttattcagaccgaggttgatgacaaagcaatttatcgttcagtgagtgaaggggtgataagcaagaggggtactacgaccccagcggcacgtgcctccttcatttaactttgtcagcagtcggcgcgggggattaaccccgcttatcgtgttcaattatttgtaagcatcctgatggacgccaaccgcacggcctgatggatcatccatatttttgaatgattcatcccattcaatggctttagctgatgaacaggcaacagaggggccgccagggacacattccgccgcactaggtagcgggaacagctcttcaaagatttcacggtacaaatacccttctttcgagccaggtgtgttgtacgggaagcgaaagtgagcggtttccatctgttggtcagtgacttgctcggctgctttctctttcaaggtgtcaatccagctatagccaacaccatcagagaattgttctttctgacgccaggcgacgctgtgtggcaggtaagattcgaaacattcgcgcaggatatgtttctccattttgccattgccgcacattttatcctgtggattgatacgcatggcgacatcaaggaagtttttatccaggaagggcacacgagcttcaacgccccaagctgacatcgctttgttggcacgggcgcagtcatacatatggagagctaacagtttacgcacggtttcttcatgtaattctttggcgtttggcgctttgtggaaatagagatacccaccgaagacttcgtcagaaccctcaccagatagcaccattttgatgcccatggctttgattttacgtgacatcaggtacatcggcgttgacgcgcggatagtcgtcacatcataggtttcgatgtgataaatcacatcgcggatggcatccagcccttcctgcacggtgaaatgaatttcatggtgtaccgtgcccaagtggttagcgacttcttgtgctgcgcgtaaatcgggtgagccaatcaaaccgacggcgaaggagtgcagttgtggccaccaggcttcgctgcgttcattatcttctacacggcgggcggcaaattttttggtgatagcagagataacggatgaatccaggccaccagacagcaataccccataagggacatcggacatcagatggcttttaaccgcatcttccaatgcgttggcaagttggattttgtcggttacgttgtctttgacgtggtcgtaatcaaaccaatcgcgatgatagtattcgcggatctcgccatcctgactccacaaatagctgccagcagggaattcttttatggtgcggcaaacgggtaccaaggctttcatttccgaagctacaaacatattgccgtgttcgtcgtgccccatatacagcgggataatacctaaatggtcacggccgatcaggtaggcgtctttctcggtatcgtataggacgaaggcaaacatcccttgcagatcatcgaggaacgcgggccctttttcttgatacaacgccagaataacttcacagtctgaacccgtttggaaggcgtaacggtcgctatattgctgacgtaatgcttgatgattataaatttcaccattcacggccaagatatgtgtgtgggcggcattatacagcggctgggcaccggtattgacgtcaacaatagataagcgctcatgggcgaggatggctttatcattcgcccagacaccagaccagtctgggccacggtgacgcatcaaacgtgacatttctagcgctttcttgcgtaattcaatagggtcggttttaagctctaagaccccgaaaatagaacacataataatctccctaatgtctctgctttggcggtgatgatcttgacattgcgttatttatcgccaggggctttttgggcgtttgctatcgattgatgcaagcttggccccatgacgatgcaattgtctaaatgacctgtaaaacgaatgaacgtgtaaaacgcgtaatttgtaaaaataatgcaaaaaacacgccaatttacagagccaatgatttgccgctatagctggcgcggtggtgataacataaaaagaaagtgcgccaaaatggggcgtgatggcaagagaatttggtgcactgcactaaaaaggggaattaggccaaaaaagcgtggcggccgtaaccgccagtagatcttagataatatcgatgtcggcaaccgaggggtaaacgtagcttggacggaacggcatggcgtcgatatcagtaagggttgagacaccggataagaccagaatcgtctccagaccggcctggaagcccgctaaaatatcagtacgtaagttatcgccgacaatcacggtgctttcggaatgcgcctgcattttattcagcgccgcacggatgatccatggacttggcttaccgacataaaacggtttgcggcctgatattttttcaataggtgcgcacagagcaccacaggcaggggcgaagccgtggccgtggctgtccgggttagtggcaataaaacgtgcaccattggcaacaaaataggctgctttatgcatcatgtcccagttataagaacgcgtctcaccgacaataacaaaatcaggattgatatcggtgatggtaaagccagctttatagagttcgtgaactaaagcaccctcaccaataacataggcttttttgccatcctgacggcgtaaaaagtcggccgttgccatggctgaggtataaaacgcgctttccggcacatcaagcccggcagtgataaagcggttagtcagatcttgcgccgtctgggatgggtagttggttaggatcaccaatggcattccagcatcctgaatacgggctaaaaagtcattggcgcccttaatggcggtgttgtcatgtaataacaccccatcgatatcgcaaataacgcttttgattgtcattgtttatattactcatttagcgcggcaataggtcactataacatggctgtggccatgacagtttctttcaacctacgggtgagtttctagcaaacgttgcagcaagacaccattgagcatagcgcgcttagccagtgcgaaagcgccgatagccgactggtggttaagttgtgatgtcactatcggcaggttttggcggaagtttttcaaaacttgcgtattaatgcaaccctgaatggcgggtagtaggattttctcggcttcaataatttcaccggcaatcaccactttttgtgggttgaataagtttatggtgatagcaatggctttccccaagtagcgaccaacatgttcaatcacttcgcaggccagcaagtcaccgcggtttgcggccttacagatagcaccaatatggcagtcatcaagagacagcttacttggataaccctgggtgagaaggtgcttgacgcggttttcaatcgcggcgttggatgccacggtttccagacaaccaaagttaccgcaatagcagcgatcacctaatggatcaatctgaatatggcctatctcgccaacgttgccgttgctgcctaaaaatatttggctgttaacgataataccggcacccgtgcctcgatgtagacgaaccaaaatggagtcttcacagtcacgggttgcaccaaaatagtgctcggccagtgccaggctgcggatatcgtgacccacaaaactggtgacgttaaagcgcgcttgtagattatcgactaacggccagttactgacactgatatgcggcatatagcgcacgatacctttgctttgctcaaccagcccaggcaggataaccgcgatggcaatcagttcacgtaatttacgctgataggcgtcaataaactgactgatgatattaaataaggcgtgttccagcgtttcttgtgttcgttctggcagggcatagtgctcttcacccagcgatttaccgctcatatcaaagagggtgatcgtggcatcattacgacctaaacggactgcaacggtatggaattggcggttttccgtcacgatagagatagcgcgacgccccccggtggaggcttgctgatcgacctctttgatcagcccgcgctccaacaattgccgggtgattttggtgacactggcgggggctagctggctgagatcggcaatctgtatgcgagaaatcgggccttgctgatcaattagccgataaaccacggctccattgagttgttttaccagatccacgttaccaatttgtgcttgtccgccggtgctcatcaataaagttactcgcttatgataaaacctcgttgccattaacgatggttttagtgattttataatcgcgggtaaaggcagtcaggttggcaactttgccgacttcaatacttcctaactgtttatccacgccaatggcgcgggccgcataaagtgttgccatacgcagggcttcatccagcgcgataccgacatgttcgacactgttttgcaccgcttcaatcatggttagtgccgaaccgcttaatgtgccattttcgtctacgcataaaccatcgcgatagtatattgttttgccagcaaaaataaattgttcaattttagcaccggcaggcgcagtggcatcggttaccagcaccagtttttcgccttttaggcgcttagcattgcgaatattggcccagtcaacatgcaggccatcggcaatcacgcctgtgtatacctctggtgtatcaaaaatggccccaataaggcctggttcacgccccgaaatgtacggcattgcattataaaggtgggtcgcaaatcggataccggcggtaaacccttgacgggcttgctgataggttgcgtttgagtgcccggcagaaaccaaaatacctgcttctgtgagctgctgtatatatttaggatcaaccatttcaggtgccagagtgagtttggtgatcacatcggcattggcacacagatagtcaatcatttcagcgctgggcttacggataaaggccggattgtgggtgcctttcttcagtgggctgatataagggccttcaaggtgcaagccgagcgcctgatgctggtttttttgcagatatgaacgcatgacatcaacgccgtgcttcataaattcatcgctgcaggtaatcagtgtgggcaggaagctggtacaacctgatttttcattggctcgctgcatgatatccaacgtctctgctgagatagcctcgagagagtcattgaactgcacaccaccgcagccattgagctgaacatcgataaaaccgggggccagaatggcaccacccaaatcgcatatctcaataccagccggaagttcatcgacaggacagatacgttcgatcaatccatcagcaacgacaacagcatgattatccagtacttcatggctggtataaatacggccgtgagttaaagcgtacatctgagccccctaatagtcattaaagatcttttacgttttcagcttctaattcgcggaaatatttcacggttttgactttcagttccatcgtggaaggttcatcgcacaccatgatggctttggcatgaagttgcaggcaactgatagtccacatgtggttgatgctcccttcaacggcggcttgcaaagcttgtgctttaccatggccggtcaccagaatcatcacttcctctgcatcaagcaacgtccccaccccaaccgtcaatgcatatttaggcacgagatttgcatcaccaccaaagaaacgggagttcgctatgcgggtttcttgtgtcagggttttgatgcgggtacgtgatgccagagaagacgctggttcattaaaggcgatatggccatctacccctacgccgcccatgaacaggtgaattttaccgtaagacttaattttttcttcataacggcggcattctgcatcgatatccgctgcgttaccatttaacagattgatgttttcagccgggatatcaacgtgatcaaagaagttagtgtgcatgaaggtgtagtagctttctggatgttctttcggcaagccaacgtactcatccatgttaaatgtcaccacatgcttgaagctgacctcgcccgctttgtgcatcgcaatcaaatacttatatgcctccattggtgtgccgcctgttggcaggcccagaataaacggacgttcggcagtgggtttaaacgcattgatgcgattcactatatggcgagcggcccatttaccaacttcggcagtatttctcagtgggataagtctcatcgtgcacctctttgattgctaatagtggctattttgattgctaaaagtggctatgcttaacgcggtttgaatcatccagctaagcgtaactcagattctgacccatgcgttggtttgatgtttagttcattttttcggatgataaaataagttttgcgtcatggctagtattttggtgtttttttactgggttttggtgatatttatcacaaaatagggggttttaatttgcgttacgaaataatttttttacactccaagatgagtaatgcgtgttgtgaataaataagagtctgtcatgtgtttatataatgtgtgccatgcacttttctaaaaggtagtgagcgtttcaaataaactacttataagggtccgatatcggacgaacagggggaaagatgagtattcttggttacttacaaaaagtaggtcgagcgttgatggtccctgtggccacactgcctgcggccgcgatattgatgggtgtaggctactggatagacccagtcggttggggggctgataatgcactggcggcattattcatcaaatctggtgctgcaataatcgaaaacatgtcggtactgttcgcaattggtgttgcttacggtatgtcaaaagataaagacggtgctgcggcactgaccggttttgtaggtttcctggtattaaccacgctgtgttcgccagcagcggtttcgatgatcaaacagattccacttgatcaagtccctgccgcatttggcaaaatcgaaaaccagttcgtgggtattttggtcggtattatctctgctgagctttataaccgtttcagcggcgttgaactgccaaaagcgctctctttcttcagtggtcgtcgtttggttccaatcttgacgtccttcctgatgatcgcagtggcctttatgctgatgtacatatggccactgatttataacgcattagtgaccttcggtgaatacatcaaagatctgggttctgttggtgcgggtatctatgctttcttcaaccgcttactgatccctgttggtctgcatcacgctctgaactcggtgttctggtttgacgtcgctgggattaacgatattcctaacttcctcggtggccaagaatcgatcaataaaggcaccggcattgtcggtatcactggccgttatcaggcaggtttcttcccgattatgatgtttggtttaccgggtgctgcgttggcaatttaccactgcgcacgtccagaaaataaagcaaaagtggcgggtatcatgatggcgggggcatttgcagccttcttcacgggtatcactgaacctcttgaattctccttcatgtttgtggcacctgtgctgtacttcttgcacgccgtgctgaccggtatttccgtgttcatcgccgccagcatgcattggatcgcgggctttggtttcagtgccggtttagtggatatggtgctctcttcccgtaacccgttggctacgcaatggtacatgctgatcccacaaggtctgatattctttgtgatttactacttagtattccgtttcactatccagaaattcaacttattgacacctggccgtgagctggcggtggaaggcagtgaagaagatggttacgacgtaaatgttgataaaacgccagcagtgaatgaaagtgaaatcaatggccttgctcgtcgttatattggtgccatcggtggttcagacaacctgacggccattgatgcctgcattacccgcttgcgtctgaatgttaaagattcagccttggttaatgacagtgtagctaaacgattaggggcttcaggtgttattcgtctgaataagcaaagtgtacaaattatcgttggtactcgtgcagaactgattgccgcagcaatgcgcacggtgctggcggggggcccaatccccgcggcaagcagcaatgctgcgcctacgggtgcaagaccgcaggcggtcattaacaccgcgaaaacggcttctttagttctggtttcgccaattaccggtgatgttgtgccattggcgcaggttcctgatgaggcttttgctagcaaagcggtaggtgagggggttgctatccgtcctacagacaaaatagttgtttctcccgctagcggcactattgtgaaaatcttcaatacggatcatgcgttctgcctggaaacggaaaccggtgctgagattgtggttcatatcgggattgataccgtgaagcttaacggccagggctttacccgtttagttgaagaggggacgacagtggttgctggtcagccggtgttagaactggatctggcttatctgaatgccaacgcgcattcaatgatcagcccagttgtcgtcagtaatattgatgactacgcggggatctcgctgttggcgagcggttcagtcgttgccggtcaaagccaattatttgagattcgtggcaaataatttgtttgaaatgagccgtattccgtttgagattcagggcgataacgtacaggtgtactgaataaccgatctgaattttaatcgaaccaacgggaagagagcgatctcttcccgtttttttgttttgtttgccgtaacaaacggttgtttccgggccgggcttgttggattatatgcggttatgtttgttgcgtttgcattgaggaatagaacaatgagtgaggcagaagcccgcccaagtaattttatccgtcaaatcattgacgaagatttagccagcggtaaacacacgtcggttcatacccgttttccgccagagcctaacggctatctgcatatcggccatgcaaaatctatttgcctgaattttggtattgctgaagattatcagggccaatgtaatttacgctttgatgacactaatccagtgaaagaagatgtcgagttcgtcgagtcaattaaacgcgacgtagagtggctgggcttcacttggagtggtgatgtacgctattcctcagactactttgatcaactgtatcagtacgctgtggagttgattaacaagggtcttgcgtatgtggatgagctgacccccgagcagatgcgcgaatatcgtggcaccttgactgcgccgggtaaaaatagcccatatcgtgaccgcagtgtggaagagaacctggcgctgtttgaaaagatgcgtgcggggggttttgctgaaggcaccgcctgcttacgggccaaaattgacatggcgtcaccgttcattgtgatgcgtgaccctgtgctgtaccgcatcaaatttgcagaacatcatcaatctggcaataagtggtgcatctacccgatgtatgacttcacccattgcatttccgatgcgctggaggggatcactcattcattgtgtacgttggaattccaggataaccgtcgcttgtatgattgggttctggataatatctcgattgattgtcatccgcgtcagtatgagttctcccgtctgaacctcgaatataccatcatgtctaagcgtaagctgaaccagttggtcacagagaaggtcgttgagggctgggatgatccacgtatgccgaccatttctggcctgcgccgtcgtggttataccgcagcgtctatccgtgagttctgccgccgtattggtgtcaccaagcaggataacaatgtcgaaatgatgtcactggaatcgtgtatccgtgatgatctgaacgaacatgcgccacgggcgatggccgtgcttgacccgattaaggttgttattgaaaatcgcgcggcgggtgaagagtggctgacgatgccaaaccacccgaataacccagaaatggggagccgtcaggtgccattcgatagcgaaatctacattgatcgggctgatttccgcgaagaagctaacaagcaatataagcgcttggtcttgggcaaagaagtgcgcctgcgtaatgcctacgtgatcaaagctgaacgtgttgagaaagacgcagaaggcaatgtcacgacactttattgcagctatgacgccgagacattaaacaaagatccggctgatggacgcaaagttaaaggggttattcattgggtttctgttgcccatgcgctgcctgcggagatccgtttatacgatcgcttgtttaacgtaccaaacccagccgcggcggaagacttcctgtcaaccatcaaccctgagtccttggttatccgtcagggctttgttgagccaagtctggccgatgcggtatcagataaaacctatcagtttgagcgtgaaggttatttctgtgctgatagccgttattcacgtcccggtgctctggtgtttaaccgtactgtcggcttacgtgatacctgggcggcgaaagccactcagtaaactttagcgctcagattcaattggcgtggcacagtccacgccttttttgtctctgacaaacgggttctgcttggtttattaaacaccgggtcctgtcctcctttttcccctctttatttttttattcattggtcaatgacgacatatttcccattcctatttaattaaatgcgttatctgtaagtctttatttaatattcgctttgcaaattaactgagcaaaaatactatttttagcgaactcttttgtattttattgggtgatttgtagtgattaaaaaaatcaatgagagaagattattaattaaatatgtgaggttttttaatgacataaatgaaattatgttttttttcggttatgtgctcattgtcatactttgaatatatatctctatttttgattgataattcgcgtcgcgaaaaatagtctgtgtttcagcaaagcggtaaataacaccatttttaaatcacatgattcttaaacaatgcgctttttaagcgatacgcattttgaataacgcattttttaagcaatacatttttaaacatgacattttttaaaaaacatacgtttaaaagtcagtgctgatggagataagcctcagcaaaattttacccacttagggtttttaaggcgaagtctgtgagctgtggtggactcaggcaacgcacttcaaatgtgatgtcaaagaggaattttttcatatggttacgcactgtcagattgctgcacacaaggctaaacgtaaaacgttagcgctcgccatcgcgggtgtattgttcggaacaggatttatggcggtcccagaggccagagctgacggttttattgatgattcatccctgactggtgggatttattattggcagcgacagcgtgatcgtaaggatatgacgccaaccagcccagagtacggcaaatatgtcgctaacctgcatcactccacttttaacgctaatttagctttctcttcaggttatgtggcggacatgtttggtctcgatttagcggcatttggcgcggttgaaatatcgaacagcggcccggcagcaccaaatgaaattggcttcagtgacgccaaaacccgctgggacgaaaagtggaccggggataagagtggcgtcagtgtttatagagccgcagccaaatttaaattaggtgatttctgggcgcgcggggggtatatccagccaacggggcagacactgttagcaccacactggagctttatgccagggacttatcgtggcgcggaaggtggcgcgaaatttgattttgatactgctggcgcgttgtccatgtcttatatgtggacagatgaatataaagcgccgtggtaccaaaatatgtatcacttccgtcaagcggatggcctgaccggtgtcagttacctgcattcatttggtgctaaatacgactttaaaaataatctggtgatggaagcggctttcggccaggctaaagattatatggaccagtactttgctaaagcgtcctatgccttcccggttgccggtaatgatctgcgcaccacttaccaattctatggcgcaaaagacaaagttgatggcggcgcgagcaatgctaatgatgtctatgatgggctagcctggctacaagcgctgacgctgggttacaccacgggtccatttgacctgcgtttggaagggacctgggctaaagctgatggtaaccaaggttacttcctacaacgtatgaccccaggttatgccacatcaaatggtcgtttggatgtctggtgggattcccgctctgacttcaacgccaacggtgaaaaagcactgtttggtggtgtgatgtatgacctgaaaaattggaatatggctggctggtcggtaggcacctcctatgcttatggttgggatgcgaagccaagcaccaatccaaaatttgaccaaaatacccgtctgaaagaatcagcatggaactttgacattctctataccctgcaagaaggccgggcaaaagggacgctcttcaagctgcactacaccctgtatgacaaccacaccaatatcccaagttatggcggtgggttcggtaacgtcttccaagatgaaaaagacgttaaatttatcgtaattgcaccatttactctcttctgattttgataattctccccggcagtgatgttggggagatagccggcagcgttggatggctcgaaaatcagataacccgcgttgcattgatgcagcctataccggtaacggtcaggcctaaaggcgcagtgtaggaaactttggcagggaattcggcgctattattttggagcaataagtcgcggaacaataaatcacggaacaataagtatcggaacagcgggacaggttccgtaatagccggttcagtaataggtaggtttcgtaataataaactccgatagcggcacgcctgtcaccaatagttattaattatggatgaggttagtaatgaacaaatttaagttaaatgcgttggcggccatcacagctacctttggtttgattggctacgcgaacggtagcgccaccaatcaacaagttgttgaccaactcagtaccttgaaagttaactataaattattggataaccgtgctgctgataatggcgttgattgcgccaaattgggtgctgattgggcatcttgtaataaggtcatgataacgctgaccaacaccggggatgagatcaaaggccaggactgggcgatttattttcacagtattcgtatgattttggctgtggataacgatcagtttacggtgactcacctgacgggggatctgcacaaaattgaaccaaccgctaagtttgctggtttccccgccaatcagacaattgaaatcccaattacgggggaatactggcaattatttgccactgactttatgccgcgttggtatgcaacctcgggcgatgccaagccaaaagttttggccagtactgatacggaagacattaacgcatacctgacaccgtttaccggtgaccagtggaagcgtaccaaagacgataataatgtgctgatgacgccagaatcacgtttcgtcaaaaacgaggcagtgaaaacactctctgcggctaacctgcgtgggcagattatcccaacaccactggacgttaaggtttatccgcaagatgccgatctgagcctcggtgtggcgctggaattgagtgcgctacccaaaccggcctctgatgccatacagcaacgttttgaattgctgggcctggcgctaagcgcgacgggctatccgattaaaacagtgattcagccaacggccttcaacggggatcacgctgtttccggtgcgtatgaactgaaaattggtgagaagggcgcagaggtgattggttttgatcaggtcggtgtattctatggcctgcaatctatcctttccttggtacctattgaggggagcaaaacaatagccacccttgatgcgaaagatgcgccacgctttgactaccgtggtgtctcgctcgatgtggggcgtaacttcaaaaccaaagcggcggtcctacgtttattggatcaaatgtctgcttacaaactgaataaattccacttccatctgagtgatgatgaaggctggcgcattgagatccctggcctgcctgaattgaccgatgtcggcagccagcgttgccatgatttgactgaaaccacctgtttgctaccacagctaggctctggccctgagagcaataatctggggagcggttatttcactcgcgctgattacatcgatattctgaaatatgccaaagcgcgccagattgatgtcattcctgagatagatatcccggctcacgcccgtgctgctgtggtatcgatggaagcgcgttataacaatttgatgaaacagggtaaagagaaagaagccaatgaattccgtctggttgatccgaccgatgactcgaataccacatcagtacagttctatgagcgtaaaagttacctgaatccctgcctggactcttctaagcattttgtcgacaaagtcattggtgaaatggcgcagatgcacaaagaggccggtatgccgctgaccacctggcatttcgggggcgatgaggcgaagaacatccgtctgggggcgggttatcaggataagaatggcaaaattgagccaggtaaaggcatcatcgatatgcgcgttgaagataaaccgtgggcgaaatctcaggtttgtcaggacatggtcaagcaaggcaaagttcaagatattgctcatctttccagctacttcgccattgaagtcagcaaactggttaatgcgcacggtatcgaaaaaatgcaggcctggcaggatggactgagagatgccaaagatgcgagcgcgtttgctaccaagcgtgttggcgtcaacttctgggataccctctactggggcggagcggactccgtcaacgattgggccaataaaggttatgaagtcattgcctcgaatccagattatgtctacttcgatatgccgtatgaagttaacccaagtgaacgcggttactactgggcgacgcgctttagcgatgaagccaaggtgttcagcttcgcacctgacaacatgccacagaacgccgaaacctcggttgatcgcgatggtaatcatttcagtgcgaagagtgataaaccctggccgggtgtacagggtatctccggtcagtcttggaatgaaacggtacggactgatgagcagatggagtacatggccttccctcgtgtattaccgctggctgagcgtgcatggcatcgcgcatcctgggagcaggagtataaagcggggcgtgaatataaaggtggcgagactcagtgggtcgatactcaggcattaagcacggattggcagcgtttcgctaacattatggggcaacgtgaactggcaaaactggataaagcgggtgtggcttaccgcttgccagtaccgggggccagagtggtggcggggcagttggaagccaatatttccttgccaggcctccttatcgagtactccactgatggaggcaaaaaatggcagcagtatgatgctaaagcgcaacctactgtcagcggtgaagtgatgatccgttccaccagcccagacggtaagcgcagtagccgtgcggagccagttaacatctgaattagggtatttggctaatcatatctgacgctgtagcttgttttagtcacggttttggttgcgtctggttagtgtctttttttgcatattaaagttgagttgatcgtatttccccggctggtccggggatttttttgcccgaaagagaccgttaaccgaaagttggctggtggctgttttctgagtgacgggcaggtgaatgactggcggctaatacaacgattttctacgggcggggagtgctgatggggcaacgaagaatagccacctgactcacgacccagtttaactcgggtagctagcgggaaaggcggccatctgattgcgtgtttatgtcaacagcctgatgtgtaacgctctagtgacatggccttatcaaacataaacagtaaacctagcagtgcttaaaatctttataagagtaatgcgataaaacgatattatcttttactgtgtgcagactcatcttcacggcaattgccggtttcacagtgaccgtataaatacaggctatgattagtcagcttgatgccatgttgtttagcaatttcacgttgaagtgattcaatggattcgttgctaaactcgatcactttgccgcaatccaggcaaattaggtgatcgtggtgatgttgttgagtcagctcaaaaactgatttacccccttcgaaattgtggcgggtaacaataccagcatcatcaaattggttcagaacacggtaaaccgttgctaagccaatctcttcaccaatatcgatcagttttttataaagatcttccgcgctgacgtggtgacacgcaggattttgcaacacttccagaattttaagccgggggagtgtgactttaaggccagcgttttttaaggctttgttgttgtcagtcatgcggattcagtcctgttacaatcgattcaaattaaggctgtttagcctatgacatccgtggcgcaataatcataattgcgtcttattatagagctgctagccccaaatgaaaacggtggttgttaacaaagatatcattgcacactttgtaagattaatcatgcagtgtattgatggatgggggaaacacatcacttgagtgtacagggctcagatgtcaagttacaaacttgtagcggtttattttcattttgcccagacgaatatgcggatctgtgggcggcttaacaaagcggggtgccagtgactggaacagaaacgctctgctgtgaatactatcgcagagcgtttcttgttgcggggagattaaccgataatctctgacaagttcagctcttcactgatttgtttaacccacgcctcaacacgttcattcgtcagttcaggttggcggtcttcatcaatggccagaccaataaagtggtcatcatcggccaaccctttggaggcttcaaagtgatagcccgcggttggccagtggccgacaatcgcagcgccgcgtggttcaatgatatcgcgtatcgtccccatcgcatcacagaaatactcagcgtagtcttcctgatcgccgcaaccaaacaaagcaactaatttgccgttgaaatcgatctcttccagtgttgggaagaaatcatcccagtcacactgtgcttcgccgtaataccacgttggaataccgaacagcagaatatcgaagctttctaaatcttctttactgcttttggcaatgtcatgaacctcagcaacctctttgcccagttgcttttggatcatcttggcaatattttcggtattgccagtatcgctgccaaagaaaatgcctacagttgccatataacttaataccttttaaattcaaatatttacgtcaataattgagcgtattgcccaacaatataacacatttcaatagggcgacataatgccagaaaattccgtcagactgatatcaagtttatgcgatataaaatcttttgtgggtgactcgctcttatcttgccattgccgataaccgtggtgtaaccgagagccatcatttgtgataccaaaggagggagggccgcactcaggcagcaggacaaatagggaaaatgtgggtttgataaacgtgagccccggcaggcacatcagggctaagcaggaaagcctaatcataggaagtcataacggtataaaaagtcataacggcataaaagtagtaatgacggcataaaagtaataacagcgtggcgtaatcacttacaccacgctgttgtggtaaccgacagggttagcacccttcttgatcatgcgctaactgagcaagtaacatctgttcaatcagctcactgcggctgatgttacgctgctctgcaaggctgttgagagcatcgacggcatctgcattaatcttcagttccacgcgtcgtaagccacgtactttatcgcgccgtagttgatttcgcttattaattctaagctgttcatcacgggataatgggtttgttttcgggcgccccggacggcgttcatctgcgaacagatccagcgtcgtgcgatccgtttgttcttttgccataggtagcggtactacaagggagttacatcagaaagcgtgacggagcctttccagatgattcggttaacacgtttcaggctgatagcacacattgaattacctatataccgacagcctgaatttgcatttgccatcgggcctgtccaagaacagcaaccgaacaccgcagcaaaattatagcgcgccataataccctagccaaccgagcaacgacaatgccttactgtgattagattgggctaattcgttcttttttgcacaatttttccacaggaaatacatttcttttccccaaggtatgatttttaatcaacatgacgggaatcttgcgttatgcggcatcaaggaaacggtggattgcccgcaacacagaatctggtttttccgcatggacccaatgaccggttccggcgacgacatgcgcacgggcttgtgggaactgacgggcaatatcatctcgatagctgtcttgaatataaggagataactcaccacggataaacaaaataggatgtggccaagggggaatgggctgccagccaataatgttctcgtactgatcccagagggcagggacattaaatcgccattcaccgccctgaaatgattttagtaagaactgaataaccccttcttcttttattaacgtgcgcatcagttgagcggcttcgttgcgctgagtcacaccagcggcactcacagcattaagcgcggcgaaaatagtgtcatgacggcgtacctgataattcactggcgcaatatcgatcgctaccagtttttcaacccgatttggggcaagcgcggtcattgccatcgccacttttccgcccatggaatggccgataataatggcttgtgttattgccagttcatccattaacgccaacacatcctgcgccattacgggataatccatctgtggtgcacggggagataagccatggttacgtaaatcgacctgaataacattatggtgttgctgcagatcgcgagccaatacacctagattatccaaattgccgaataatccatggatcagaatgattggcagggctgaggtaggggactgtgcgttttgtaagcggaaatttaatttcatagcgagcgacgttcatactgagagatattctggttagggtaccatgaatgcctgaagttgatctttctgatgcttaagtgagggcgaccttaggcgcagatatttagccgtttgagagtacgctcagaattctgtgtcacgttaaaatcattatagcgttattgtcgtccccccaaatttagtcttaccatttaatagagttcttagagcttttatgggatttgaggcgagtatcgtgatagatataaaaaatgattaataatcatcttgttgatgaagataataaaaattatcacttaataataaccggaaggattattggatagagatttttaatgaattgccttctgaggtgaagatatgaatgatttgatgatattccatttttagctcaattactttgtataaccataattccggcttaattagagcatcaaattccatagatttaagttataaattcaaactgttaagtctgtgtgttcatctcaataaagtagttaaagatgccaactaacatcagttcaggtcatattttcaacattatatactaaataagctactgactgtaattttatccagtaaacgcctgcgttactattgaaaaatcagcgactaaatattaggattctgattctatatgttgtgtgtttaaattttttaagcacaacatatgccaaattaatacttctactataaggattcaggccatgagtaaaaatacaaaacaaacatctggcaaggtcgcttctattgctgcgaagactttaaatgaccctaactcttctgcaatccagagaagccttgcgggttctgccctatcccaacgaggaacaccaaatcagacaagtggggaaatggagcataaagcatctgctgcactcgataatccacgttccagtgcattgacaaagcagctagcggcctctgtattagcacaagcaaataaagaccgtaaataatctgtcttgattaactattggggcgaacgcccctttcgtagaaggttgaccacctgacagttcaaaatagtcagccatcggtgatttttaataggttatttttcttggcaaaatcaaacagcctaaccatcccttcacggttggcaccaaggtaattgaccactactgaaccattagcttgcgtttatctatatgttcggccttatggatagaagacgaacgaacggtatttcgctcctgatgactcatctggcattctacatcgtcttttgaccacaaacctgactcaagcaatgcgctacaagccttaaaacggaaatcaagaccgtaaacttctgtttgggtcattttaacaaatgatctcgttggtgccgtaggatcgcaaattgcgcggtcaggtaattgacgagctcacgctttatcgctggttttaaagctttttttcgataacatctttcaatgcccgacactccaggctcaggttggcaaacatctgtttcagacgacggttttcgtcctcaagatcttttatctttttgatatcactcgcttccatgccgccatattttgccttccagttataatagctggcttcagagatggcgtgcttacggcagagttcacgggctgaaactccggcttcagcctcgcggagaatattgatgatctgttcgtcggaaaaacgtttcttcatggggtgtcctcatgttgctgatgaagacattactaacatcggagtgtgttaatcaatggggagcaggtcagtctctaatgctccccgtgctttgatgggttctaacacctgaatcagggtacgtgcttttaattcttggatgggaacactttcgatgctgggtaagatgtctttttcaatagaacgccaaatatctttcgcatgggctgcgctaacgtggctttctttcaactcgaaccatttactgtaacgaacggtgcaatagtgatccacacccaacgcctgaaatcagatccagggggtaatctgctctcctgattcaggagagtttatggtcacttttgagacagttatggaaattaaaatcctgcacaagcagggaatgagtagccgggcgattgccagagaactggggatctcccgcaataccgttaaacgttatttgcaggcaaaatctgagccgccaaaatatacgccgcgacctgctgttgcttcactcctggatgaataccgggattatattcgtcaacgcatcgccgatgctcatccttacaaaatcccggcaacggtaatcgctcgcgagatcagagaccagggatatcgtggcggaatgaccattctcagggcattcattcgttctctctcggttcctcaggagcaggagcctgccgttcggttcgaaactgaacccggacgacagatgcaggttgactggggcactatgcgtaatggtcgctcaccgcttcacgtgttcgttgctgttctcggatacagccgaatgctgtacatcgaattcactgacaatatgcgttatgacacgctggagacctgccatcgtaatgcgttccgcttctttggtggtgtgccgcgcgaagtgttgtatgacaatatgaaaactgtggttctgcaacgtgacgcatatcagaccggtcagcaccggttccatccttcgctgtggcagttcggcaaggagatgggcttctctccccgactgtgtcgccccttcagggcacagactaaaggtaaggtggaacggatggtgcagtacacccgtaacagtttttacatcccactaatgactcgcctgcgcccgatggggatcactgtcgatgttgaaacagccaaccgccacggtctgcgctggctgcacgatgtcgctaaccaacgaaagcatgaaacaatccaggcccgtccctgcgatcgctggctcgaagagcagcagtccatgctggcactgcctccggagaaaaaagagtatgacgtgcatcttgatgaaaatctggtgaacttcgacaaacaccccctgcatcatccactctccatctacgactcattctgcagaggagtggcgtgatgatggaactgcaacatcaacgactgatggcgctcgccgggcagttgcaactggaaagccttataagcgcagcgcctgcgctgtcacaacaggcagtagaccaggaatggagttatatggacttcctggagcatctgcttcatgaagaaaaactggcacgtcatcaacgtaaacaggcgatgtatacccgaatggcagccttcccggcggtgaaaacgttcgaagagtatgacttcacattcgccaccggagcaccgcagaagcaactccagtcgttacgctcactcagcttcatagaacgtaatgaaaatatcgtattactggggccatcaggtgtggggaaaacccatctggcaatagcgatgggctatgaagcagtccgtgcaggtatcaaagttcgcttcacaacagcagcagatctgttacttcagttatctacggcacaacgtcagggccgttataaaacgacgcttcagcgtggagtaatggccccccgcctgctcatcattgatgaaataggctatctgccgttcagtcaggaagaagcaaagctgttcttccaggtcatcgctaaacgttacgaaaagagcgcaatgatcctgacatccaatctgccgttcgggcagtgggatcaaacgttcgccggtgatgcagcactgacctcagcgatgctggaccgtatcttacaccactcacatgtcgttcaaatcaaaggagaaagctatcgactcagacagaaacgaaaggccggggttatagcagaagctaatcctgagtaaaacggtggatcaatattgggccgttggtggagatataagtggatcacttttcatccgtcgttgacatttacgggcgacattcacaaaaatgctttcctccgctatctggagcttttcagcttcttcatcagctcttgcttggggatcaacccctcgcactaacatggccagtttctcggctcgtacttttctggcatcagccaaagaaagtgcagggtacgcgccaagacttaccatagtgcgtttactactgttgggaagctgatagcggaaacgccaaattttcttgccggtagttttgactaacagaaataaaccatcagcatcatggagggttaggtctttgtcggtggtttttgctttttgtacttcggtgtgggtgagggggcgtgtagtccgcgccatgcaaggttcttccctgtaattggtatacgtccattggtatctatcttagcgtataccaatttgtataccaatagacactggcttcagtcggatcaccttggactactacagacacaaaaaagcccgcaaacctaggtgggatgcgggcttttcgtacttcaccggacttatctggtaataaccggtttaacatttggtggagctggggggatttgaacccccgtccgaaattactacaccgtcggcactacatgcttagtccaatcattacattcgccggccagctgcggatggacacgctactgacaaactatcctgattagttttaatgcttccaccccaggcaaggtttccacacgagctcttttaggtttgacctctcttgatccccgtcctaagagcggaggctagggagagagggctctaagcaggttattaagctgctagtgcgtagttttcgtcgtttgcaactattttttttgcggttttttacgaggccaccgcacctcggcatgcaccttgggtttcgcgaatcccgtcgaatccagaatcagccccaaagaactcagctagtataacagaactatgtcctgcgatgccagttacttaacgatttgcgtgcttcatgatgcgcgctttgtctaacttccactcacgatctctaatatcatcgcgcttgtcgttatcttttttaccttttgctacgccgattttaactttcacccaggcatttttccaatacatggagagagcgacaaccgtgtagccttctcggttcactcggccaaacaaggaatccagttcgcgtttgttcaacagcagtttacgggtacgcataggctcgcaaacaacatgagtcgacgcaacgttcaacggcgtaattgtggccccaaacaggaatgcctcaccgtttttaaacattacgtagctgtcactgatatttgctttgcctgcacgcagtgattttacttcccaaccttgcagtgcaagcccagcttcgaactcttcttcaatgaagtattcgtgacgggctcgtttattttgcgcaatggttgcggaaccgggtttgtatgcttttttctttgtcatagtatcggtcattatactgtatgcggaggcgaatgaaatcctttcccgtaagatgcttatgtattttgtctcatttgttgcgaggaatgcctggcagattttttgtctggcggtagataaatggtattatcagtgcgttttatgtctcacaggaaatgttatgccacagattagccgatctgcactggttccgttcagtgtaaaacagatgtatcaactcgttaatgatgttcgttcttacccagagtttttacccggttgtaccggtagccgggtacttgatgccactgaaaatgaaatgatagccgccgtggatgtcgccaaggccgggataagtaaaacatttactacacgcaatacgctaacagataaccagagtatcaatatgcagttggtggatgggccgtttcgtaaattaatgggcggatggcattttacaccactaagtgcagatgcttgcaaagttgaattgcatcttgattttgaatttacaaataagctgattgaattggcattcggtaaaatattcaaggagttggctgggaatatggtgcaggctttcactcaacgggctaaagaggtctacagtgcctgatattcgcgttgaggttgtatatgccttatctgaacgccaatacttgcgcactgtatctttggtggttggcagtactgttgaggatgcgatcaaggcatcaggcttactggagttacggccagacattgacctggaaaaaaataaagtgggtatctatagtcgcccggtaaaactcggtgacaaactcaatgatggtgatcgggttgaaatatatcgcccattaatagccgaccccaaagagcttcgccggcagcgagctgagcaggcaaaaaagtaaggcacaatcagcgccttattttttgttgtcactctgggcagccattgaaagagaaacgcggactatcttgtggctgagttaacatcaataggtttagaacctaacaccataacccgcattcccaatctgttctgcaattctcaaataacttagcttccggttaacgcgggctcatttttgatatcagtcagtacaccactgctatcaaaggtcaacgttaacgtttgttgcgttattttttcgtgaccaggttgttggcggaaaacgtagaaccaggtttgagtgccaaacggatcttgtagcatcggtgtgcctaaggtatacgccacttgttgctgtgtcatacctttatgaattttggaggcatcaataggtgataaatagttaccctgattaatatcaggccggtagaccaccttctccaacgttgaacaacccgcagtaagcattgcaagcatcacagcggcggcagtcagcattttacagcgcatagtaatcacattcctttagggcataggatgacgatgataatagaccttgcggcagttggaaacctttacagggcacctgtatgaccaccaaaaaggaaaaaagttaatcttttctatgcagcaagcaattcttttgcgtttgccaaggtgttttttgtcacctcactaccgcccagaagacgcgccaactcttgtaagcgggcttttttatctaaccgatgcatatgagtttcagtctcagtaccatcggtttgtttactcacaaagaaatgttgatgaccacagccggcaacttgcggaaggtgggttacgcacatgacttgagttgattcgccaagttgacgtagcaggcggccaactatggccgccgttgggccgctgatacctacatctacctcatcaaagattaatgctggggtgtccattttacgtgctgtaattacctgaatagccaaggcgatgcgagacagctcaccaccagatgcaactttgaccagtgcttgtaggggttggcctggattggtggtgacacagaactcaattcgggttgccccttccgcactaagatgttctggctcaaatattgtttcaatggcgaacttgccatgtggcatcgatagctcatgcatgctttcagtaatcagtgcagccagttcattggcataatattgacgctcttggtgtagccgttttgctattgccagtgcttgctgatagtgagtatttactgcattactaagttgttcgtgatcattttcttgttgtgagagcagttcttgttcatccagcaattgctgatgaaattgtggcaattcttccggtgctacatggtgtttccgcgcgagatttaattgccgagataaccgtttttctagctcatatagacgatttggatccatatctaattgttccgcatagtgacgtaactcatcactggcttcactgatttggattgaggcttcttctaacatattcagtagattattaaattgttcgtccatactggccagctcggtcaactgatgtttggcagcgtaaagctggctgaggatattgttttgttcatcatctgacagtaattgtaaagtctgctgactcagggacagtaattgcccgctatttgccaaacgtttgtattcaatatcaatttgttcatattcccctgcctgtggagaaaatgaattcaattcttttagttgatattgtaataactctcggcgggcagttcgttccagcgactgttgttggtgaagtgccagatcacggcaactttgatgccaaatttgataggctgccttcatttctgccaacagagatgattgatttgcgtaggcatccaataattgtttttgatgatcgggtttgagcagcagttgatgagcgtgttggccgtggatctgaattagatgttggcccaactctcttaattgggatacgggtacaggcgtaccattaataaagcctcttgaacggccatcagcgccaatagcgcgccgcaacaggcattcattattgtcatcgagatggttgttttccagccattggcgggcagatggtgtatccgccagtgagaagcgggcgcaaatgtcagcgcgtgttgcccctaagcgcaccatgctgccatctgagcgattcccgaggcataaccctagtgcatctacggcaatggatttgcccgccccggtttcgccagtgattgccgtcattccgggctgaaaatcaatttctaactcacgcacaatagcaaagttgctgatggttaattggaccaacatggtaaaccccctgtacataaacacatgtctgtatttgaatacagtatagcctggttttatatacagtaaagtagctgaggtgatttttagaataatttttttgaccaacccaatttggtgcttaacgtattgaaatagctatagtcctttggatgaataagattgaggtgaaaatcactgcgccggattaaaacctcttccccttcctgaatgggtagggctatctggctatcgcaactgatttccaggtcgctggtaatgtgcgaaaacttcagtcggatggtgctagtgctgctgataaccaatgggcgcgcagtaagagtgtgtggaaacattggtaccaatacgatggcatccagagttggtgtcaagattgggccgcctgcggaaagtgaataggcggtagaaccggtcggggttgcgatgatcaagccatcagagcgttgagaaaaggcgaagcggtcatcaatatacacttcgaattcgatcatatgggcgactttgcctggatgcaaaaccacttcattgattgcggtactgatacggctttgttgatttgtacgtcgtacatgcgtttctagcaggaagcgttgttcactcaggtactcgccttccaaaacgtctgaaagctgctgcagagcattatccgggtctaaatcggtcaagaaacccagattacctcggttgacaccaatcacttttatatcataacgggcaagtacccgtgcagcaccgagcatgttgccatcaccgccgacaacaacagccaaatctgctttttggccaatatctgccaaactccctgttatggcatcggttaaattgaggtcatgagcaatctgttgttcaaccataacggcgtagcctctggcttttagccagtggtagagtatttcatgggtggcaagtgcagccgggtgtcgcgggtgaccgacaataccaatacaatcgaatcttctattattcattgccgtgattttccttaatggagtgtcttttaccccacattatgaccggttcccttgaatccccggttttgatccccataataagccaagtagcgagattaatgctaaaacgcggagatatccatgagtagtaaagaacagaaaacgccaaacgagcaagtctcggaagaaatggaaaatacagcagagcagcaagtggaagcaacacaagagacgggggaatgtgtagatccgcgtgttgcagagcttgaggtgcagttgtctgatgctctacagcgtgagcgcgaaagcctgctacgcgctaaggctgaagttgagaatatccgtcgtcgtactgaattggatgtcgagaaagcgcataaatttgcactggagagattctcatctgaattattgccagtgattgacaatctggagcgcgctctagataccgctgataagaccaatactgaactgacctcaatgattgaaggtgtcgaactgacactgaaatcactgctagatgctgtcggtaaatttggtattgaagttgtcggcgagacccatgtgccgtttaaccctgaggtgcatcaggccatgacaatgcttgagtctgctgatcacgagccaaaccacgtaatgatggtgatgcaaaaaggctatacgctgaatggccggctgttacgcccagcaatggttgcggtatctaaagcgaaatcgtaaagtgctctaacgttaaaaggcacctcaacggtgcctcaaattgctaacaaagtcctggcctcctagccgggactttgctctaattttacgcggtaacgcgtacctgcttattttttcaattggctctggaaatcacgttctgtatagccagtataaagctggcgcggacgggcaatcttgatgccgtcattatgcatttcgttccagtgagcaatccaaccgatggttcgggcaatggcgaatatcaccgtaaacattgacgatggaatccccatggctttcaggataatacctgaatagaagtccacgtttggatacagttttttctcaatgaagtaaggatcgttcagtgcgatgttttccaactccatcgccacttctaacaagctgttattcagcttcagctcttctaacacttcatgacaggtttcacgcatgacggtggcacgagggtcatagtttttatagacacggtgaccaaaacccatcagacggaatgagtcattcttatctttcgcgcggcggataaattcagggatatgctcaacagttttaatctcttccaacatcttcaggcaggcttcattggcaccaccgtgcgcagggccccacagggatgcgatccccgcggcgatacaggcaaacgggttagcgccagaagagccggcagtacggacggtcgatgttgacgcgttctgttcgtgatctgcgtgcaggatgagaatacgatccatagcgcgttccagtactgggttaacttcatatttctcacatggcgtagagaacatcatgtgtaggaagttacccgcgtaggacagatcgttacgtggataaacaaacggttgacccagtgaatatttataacacatcgctgcgacagtcggcattttagacaacagacggaaggcggtaatttcacgatggcgctcgttattaacatccagagcatcatggtagaaggcggctagcgcaccagtaaccccacatagcacggccatcggatgtgaatcgcggcggaaaccatggaacagacgggtgatctgctcgtggatcatggtatgtcgggtcactgtggttttgaacgttttgtactcttctggcgtaggtgtttcgccgtacagcagaatgtaacaaacttccagataagtagaatcttttgccaactgggcaatcgggaagccacggtgcagcaaaataccctgatcaccatcaatataggtgatttttgattcgcaggatgcggtagaggtaaaaccggggtcaaaggtaaaataacctttagaacctaaggtgcggacgtcgatcacgtcagtgccgagggttggggataggacacccagttcgatcgcagcttcgcctaaattcagcgtcgcttttttgtcagccatttacagtctccttaagtgcttattttaaaacccctaacaacggaaacatcttagatgcccggggatatcaccttattagcactgctctgttttattcatcattaatactcttggtacttgaagttgtcgggttgtcagcgataactctaattacgtgagtagataacttgatttagggtacagagtaaattgccaatacggcccgcgatccgaaggtttggatcaacagctagtgttaaaaagttgttagtgatttgtcggatacttatagtttatggatcattgcctacgatatctatggggatattgactcaatacactgttgcataacttaagcttgtggggaagtgtatccgttgacctttagtgcatcataggccttatttctaccctagttgtaatggaaatgtttattctttgtcaaatcagataattgattttatatgaattgtgtaaatcgtgatcctaatcactgttcaggggaaatgttatcaatcagtttgtgggggaattgtaataagaatgtgaaccccctatactgccgccaggtctccggattaccctgaagtaggagcacccagcgttatacagaacatgctgtttaagcattcaggatgcaatacttaaacgtgcgatgtgaagggtttcgactcttaacgctgtctgattccccacccaggtccggaggaaggaaaataataagagctgtgtgggcaaaaccgtgaaaaaacaaagacctgtcaatttggatctgcaaacgattcgatttcctgttactgcgatagcgtccatcttacaccgagtctctggcgtaattaccttcgtggctgtcggtatcctcctctggctgttgggtttgtctgtttcctcacaagaaggattcatgcaggcagcaaccatcatgaatagtttttttgttaaattcatcttttggggaatactcactgcgctggcttatcacatttgcggtggcatccgtcacttgttaatggattttggctatctcgaagagaatttagccgtgggtacccgttctgctcaagtggcaatgggattaaccctcgtgttgtcagttttggctggagtcctcgtatggtaagcaatgcttctgcgttagggcgtaatggagtacacgattggttgttactgcgtgcttctgcaatcgtcatcaccctgtatgtcttttatattctgggcttcgttgttattgtcccagacatcacctatgaaatctggcgcggtttcttcgcgtcacacatcacaaaagtatttacgctgctgacattgctgtcgattctagctcacgcttggatcggtctatggcaggtattgacggactatataaagccactggcgatacgactggtgttacaactggtcgtcgtgattacgctgttggtttatttattgtatggaacaattgtggtgtggggagcttaaatgaatctgccaatcagagagtttgatgcagttgttgtcggtgcaggtggtgccggtatgcgtgccgccctgcaaatttcacaaatgggcctgtcttgcgccctgatatctaaagtcttccctacccgttcccataccgtatctgcgcagggggggattaccgttgcgctgggtaatacccatgaagataactgggaatggcacatgtacgatacggtaaagggttccgattatatcggcgatcaggatgccatcgaatatatgtgtaaaaccggtccggaagcggttctggaattggagcacatgggtttacctttctcccgtttagaggatgggagcatttatcagcgtccatttggggggcagtcactgaactttggcggtgggcaagctgcgcgtacagcggctgcagctgaccgcaccggtcatgcgttgttacacaccctttatcagcaaaacctgaaaaaccacaccactattttctctgaatggtatgcactggatttggtgaagaatcaggacggcgcttttgtcggttgtactgctattaatattgaaaccggcgaagtcgtctatttcaaagcacgggccacaatattggcaactggcggtgctgggcgtatttaccaatcaacaaccaatgcgcacattaataccggtgatggtgttggtatggccttgcgtgctggagtcccggtgcaggacatggaaatgtggcagttccacccgaccggtattgccggtgcgggtgtattagtgactgaaggctgccgcggtgaaggggggtatttactgaataaacacggtgaacgcttcatggaacgttatgccccgaacgccaaagatttggcgggtcgtgatgtagtggcacgttccattatgattgaaatccgtgaaggacgtggttgtgacggtccttggggcccacatgccaaactgaaattggatcacttaggtaaagatgtgcttgaatcccgtctgccgggtattcttgagctgtcgcgcacctttgcacacgttgacccgatcaaagaaccgatcccggttatccctacttgccattatatgatggggggaattccgactaaagtgacgggtcaggcgattaccgtaaatgaaaagggtgaggatgttgtgatccccggcttgtttgctgtaggcgaaattgcctgtgtttccgtccacggtgcgaaccgcttgggagggaactcattactggacttagtggtatttggtcgtgctgccggtatgcacctgcaagaatcattgatggagcagggcgcaagccgcgatgccagtgagtcagatatcgaagcctctctggctcgcatgaatcgctggaataatacccgttcaggtgaagatccagttgaaatccgtaaagcattgcaagcctgtatgcagaacaatttctccgtgttccgcgaaggcgatgcgatggcaaaagggttggaagagctgaaaactatccgtgaacgtttgcaaaatgcccgtttggatgacacttccagtgaattcaatactcagcgtattgagtgcctggagctggataacctgatggaaactgcgttttcaaccgctgtgtcggcaaacttccgtaccgagagccgaggtgcccatagccgcttcgatttcccggatcgtgatgatgtgaactggctgtgccattcactgtatttgccaggtactgagagcatgacccgccgtgaggtaaacatgcaacctaagctacgcgaggcattcccgccgaaagtgcgttcttattgatgcctgtgttgtgtttctaagggttaaacccgttgcggaggaataggtcatgaagctcgagttttcaatttatcgctataacccagatgtcgataacgcgccgcatatgcaagattacacgctggatgcggaagaaggtcgggatatgatgttgctggatgcacttatccagttgaaagaaaaagatccgacgttgtcattccgtcgctcatgtcgcgaaggtgtgtgtggttctgatggtctgaatatgaatggcaaaaatggtttggcctgtattacgccaatctcagctttgcaaaaaggcaataaaaagatagtgatccgccctctgccggggttaccggtggtgcgagatttagtcgtcgatatggggcagttttatactcagtatgagaaaataaaaccttacctgttgaatgacggcaagaatccaccagcacgtgagcacctacagtcgccggaacaacgggcaaaactggatggtttgtatgaatgcatattgtgcgcttgctgctcaacgtcttgtccgtcattctggtggaatccagacaagtttgttggcccggctgggttactggctgcctatcgtttcctgatagatagccgtgataccgaaacggcctcacgtttggatgacctggacgatgctttcagtgttttccgctgccatagcattatgaattgtgtcagtgtttgtcctaaaggtcttaatcctaccaaagcaatcgggcatattaagtctatgctgttacaacgtagcgcatagtcgttatcgcgtagcgcataaaatagcgatagcgctgtgagtgatgattacagtgtagtgaatgacaattatggcataacgattgttataacatagcggataatcattgcaacgcagtgcctgatgtgagtttattaacccggagaggggattctccgggtagcttcacggtagggaatctctaaaagccggcataatgtctgtttctagaggttccttgaacgggaccgataaggtccataacagaacgtgcattgagcacgtcgagtgaaccgtttttacggcaaaccgttgatattacggtgtatatgttaaccacggcgaaaactgaagcttcaaagcttaagggatcataatgcagaacggcgcaatgaaggcctggctggattcctcctatctggcgggcgcgaaccagtcctacatagagcagctctatgaagactttttaactgatcctggttccgttgatgatagttggcgttcaatttttcaacagctaccaacaacgggtgtaaaacctgatcagctccactcccaaacgcgtgagtatttccgtcgcctggcgaaggattccactcgttataactcctctatcaatgatcctgatattgatgccaagcaagttaaggtattgcagttaatcaatgccttccgcttccgtggccatcagcatgccaatcttgacccactcggtttgtggaagcaggagtctgttccagacctcgatccttcctaccataatctgaccgaagctgacttccagaacaccttcaatgtcggttcttttgccatcggcaaagaaacgatgaagctggctgatttgtatgccgcgctgaagcaaacttattgcggttctgtgggtgctgaatatatgcacattaccaacaccgaagaaaaacgctggattcagcagcgtattgaatcggttgttgggaaaccgacattcagtgatgcagagaaacgccgtttcttgagtgaactgactgccgctgaaggtcttgagcgttatttaggcgcaaaattcccaggcgccaagcgtttctctctggaggggggggattcactggtcaccatgctcaaagagatgatccgtcatgccggtaaaaatggcacacgtgaagtcgtcctggggatggcccaccgtggccgtttgaacgtattgatcaatgtgctgggtaagaaaccagaagacttgtttgatgagtttgctggtaagcataaagaacatctcggtactggtgatgttaagtaccaccaaggcttctcttccgatgtcgaaaccgaaggcggtctggtccacttggcactggcctttaacccatcacatttggagattgtcagcccggttgttattggttcagtgcgtgcacgtcgcgatcgcctggatgaagcacgcagtaatatggtgctgccaatcactattcatggtgatgcggcgatcaccggccagggcgtggtacaagaaacattgaacatgtcacaggctcgcggctatgaagtgggcggtactgtacgcattgttatcaacaaccagattggtttcacaacctcgaacccactggatgcgcgctcgactcaatactgtactgatattgccaaaatggtacaggcaccgatttttcacgtgaatgctgatgatcctgaagctgtggcatttgttacccgtctggcgttggatttccgtaatacctttaaacgtgacgtgatgatcgatctggtttgttaccgccgtcatggccataacgaagccgatgagccaagtgcaacacagcctgtgatgtatcagaaaattaaaaaacatccgacaccgcgtaaaatctatgctgacaaactgattgagcagaatatcgccagcctggaagatgcgacagaaatggtcaacctatatcgtgatgcattagatcacggtgactgtgtggtggaagagtggcgtccgatgaatttgcagtccttcacttggtcaccgtatttgaaccatgagtgggatgaagcgtatccaagcaaagttgaaatgaaacgcctgcaagagctggcgcgtcggatcagctctgcgccggaagccattgaaatgcaatctcgggttgcgaagatatacagtgatcgcgcgttgatggccagcggtgagaagccatttgactgggggggagcggaaacactggcttacgctacattggtagacgagggcattcctattcgtttatctggcgaagatgcggggcgtggtactttcttccaccgccatgcggtcatccataatcagaaaaatggttctgtttatgtaccactgtcaaatattcacagtggccagggtgatttccaggtttgggactcggtgctgtcagaagaggcagtattggcgttcgaatacggctatgccactgcggagccgcgtaccctgactatctgggaagcacagtttggtgacttcgcaaatggtgctcaggtggttatcgaccaatttattagttctggtgaacagaaatggggtcggatgtgtggcttagtgatgttgctaccacatggctacgaagggcaggggccggaacactcctccgcacgtctggaacgttatttgcagctttgtgctgaacaaaatatgcaggtgtgtattccatcgacccctgcacaggtttatcacatgatccgccgtcaggcattacgtggtatgcgccggcctctgattgttatgtcacctaaatcattactacgccatccattagcgacatcatctctggatgaactggctaatggcagcttcttacccgctattggcgaaattgatgagttggatcctaaaggtatcaaacgtgtcgtgatgtgctcaggcaaagtctactatgacttgctagagcagcgtcgtaaaaatgggcaaacagatgtcgccatcgtgcgtattgaacaactgtatccgttcccacatcaggccgttcaatcggtgttggaacaatatgcccatgtacacgatttcgtctggtgccaggaagagccacttaaccaaggtgcctggtattgtagccagcataacttccgcgaagtgattccatttggtgcttccttgcgctacgcaggtcgtccagcatcagcttcaccggcagttgggtatctttccgtacaccaaaaacaacaacaagctctggttaatgacgcgctgaatgttgaatagctagtcggttaacatataaaggatagagaatgagtagcgtagatattaatgttcctgacctccctgagtctgtagccgatggctctgtagcaacctggcacaaaaaaccaggcgacagcgtcaaacgtgatgaagtgctggttgagattgaaacggataaagtgattttggaagtgccagccagtcaggacggtattttggatgccattctggaagatgaaggtgccacagtgacgtcacgtcaggtgctggggcgcattcgtccaagtgatagttctggtaaaccgactgaagaaaaaagtcagagtacggagtcaactccggctcaacgccaaacagccagcttggaagaagaaagtaatgaaaccctcagtccggctattcgccgcctgattgctgagcatgatctcgatgcaacggcaatcaaaggcagcggtgttggtggccgtatcacccgtgaagacgttgatagccatttagcgagccgtaaatcggcctctgcagtggtagctgacgctaaagcggtagccgctgctgcacctgtattggcggggcgtagtgagaaacgtgtcccgatgagccgtctgcgtaaacgtgttgctgagcgtctgttagaagcgaaaaacagcactgcaatgttgaccacgtttaacgaaattaatatgcagcccattatggacctgcgtaagcagtacggtgaagcttttgagaaacgccacggtgtacgtctgggctttatgtccttctatatcaaggcagtggttgaagcactgaaacgttatcctgaagtgaatgcttctattgatggcgaagatgttgtctaccataactatttcgatgtcagtattgcggtttctactccacgtggtttggtaacgccagtattacgtgatgtagacacgttgagcatggctgatattgagaagaaaataaaagaattggctgtaaaaggtcgtgatggcaagctgaaagttgaagagttgactggcggtaactttaccattaccaatggtggcgtgtttggctcactgatgtcgacaccaatcattaacccaccacaaagcgcgatccttggcatgcatgccatcaaagatcgcccaatggcggtaaatggtcaggttgtgatcctgcctatgatgtatttggcactttcctacgatcaccgtttgatcgatggccgcgagtctgttggctatctggtgacggtaaaagagatgctggaagatcctgctcgcttgctacttgatgtataaactggctactcgacgtataaaaagataactgacaaagctggtcttgaggatcggctttatccagaacactacgggcttcggcccgtctcagaccttatatggatagaacatcatgaatttacacgaatatcaggcaaaacaactgtttgctcggtatggcatgccagctccaactggctacgcctgtaccactccgcgtgaagcagaagaagccgcatctaaaattggtgcaggcccgtgggtggttaaatgtcaggttcatgcgggcggccgcggtaaagcggggggcgtaaaactggttaacagcaaagaagatattcgtgctttcgctgaacagtggctaggtaaaaaactggtcacttaccaaacagatgccaacggacagccggtgcatcagatcttggttgaagcagccacggatattgataaagaactgtatctgggggcggttatcgatcgcagctctcgccgtgtggtctttatggcatccactgaaggtggtgttgaaattgaaaaagtcgccgaagagacacctgaactgatccataaaattgcattggatccattgaccggaccacagccttaccaagggcgtgagctggcatttaaattgggcttgaccggtaaacaagtcggtcaattcaccaagatctttatggggctggcaacactgttcctggaacgtgacctagcgatggtagagattaacccgttggtggtcactaagcagggcgatctgatttgtctggatggtaagctcggtgccgatggtaatgccttgttccgtcagccggaactgcgtgaaatgcgcgatccaagccaagaagatgctcgcgaagcacatgctgcccagtgggaactgaactatgtggcgttagatggcaacatcggttgcatggtaaacggtgccggtttggcgatgggaaccatggacatcgtgaaacttcatggtggcgaacccgctaacttccttgatgtgggcggtggtgcaacaaaagagcgcgtgaccgaagcgttcaaaatcattctgtctgacgacaaagtgaaagcggtttttgttaatatcttcggcggtatcgtgcgttgtgacctcattgctgacggcatcattggtgcagttgaagaagtgggcgttaacgtacccgttgttgttcgtctcgaaggtaataacgcagagctgggtgccaagaaactggcagacagcggtttgaatattattgctgcgaccagcctgacagatgcggctcagcaagttgtagcggcagtgggggctaaataatgtctattttaattgataaaaacaccaaagttatttgtcagggttttacgggcagccaagggactttccactccgaacaagctatcgcatacggtacaaaaatggttggcggtgttacgccaggtaaaggcggcacacagcatttggggctgccagtctttaataccgttcgtgaagcggtagaaactactggtgctacggcctcggttatctacgtgcctgcgccattctgtaaagattcgattttggaagcgatcgatgccgggattaaactgattatctgtattactgaaggtattccgacgctggatatgctggtggtaaaagtcaggttggaacagagcgatgcgcgcatgatcggtccgaactgtccgggtgttattactcctggtgaatgtaagatcggtatcatgccgggtcacatccacttgccaggtaaagtgggtatcgtttcacgttcaggcacgctgacctatgaagccgtaaaacagaccaccgacattggtttcggccaatcaagctgtgtgggtatcggcggcgacccgatcccaggctctaactttattgatatcctgaaactattccaggaagatccgcagactgaagttattgtgatgatcggtgaaatcggtggtaacgctgaagaagaagcggctgcttatattaaagagcacgtgactaaacctgttgtgggttatatcgcgggtgtgactgcacctaaaggtaaacgtatgggccatgctggcgctatcattgcgggcggtaaagggactgcagatgataaatttgctgctctggaagctgcgggtgtgaaaacagttcgtagcctggcagaaataggtaatgctgttaaagctgtattaccgcagtaatcaagaaagtatcaggtgttagtctaaaaatctaacgcgacatactggccaccttttggtggccttttttatacaaatggctactccggtagctgttgatacaccaatgaattggcgtaatttcagtaactgtgtaccatcatcaaaatgtaaaacggtaagtcagaacggccttttcgttgcagggggccaggttgttatgaggtgatagcactttatcacgcaacaaagtagcaacatatacgaacgcttctctcaggatgaactaatataaatatgtaaaaatcaaaactgtgatttgactcactctgaatttaataaatttaaaagttaatctggatcgcataataataatttaattacgcattatataaaccattaaattacatttttttaacatttaaatgttatataaaaacaataaaacctttagttaacatgaaaaagatttaattgttctaaatcaacttttgaacgtggtaataatgttcatataggcttaaattgtcgtagatcaatttacgacattgttaccaaaatgcctatttgttgacctatatacagaactcaacgctgggtcacgtaaaatcctatttattgtatgggattagaagcgtagtattaccgcggtgtaatattgggtagttgatattgttatttttgttgttttttttgagcattcactgctggtagttatgaggcttccgatttagcggaggtccggttgccgcaagtcggaatcttcctgcgaggagcaaggagtcaagatgtttgatattgtcgaactgtcacggttacagtttgccttaacggcaatgtaccatttcctttttgtcccattaacgctcggtctggcgtttctgttggcaattatggaatcggtttatgtgctgtctggtaaacaaatctataaagatatgaccaaattctggggtaagttatttgctattaactttgctctgggggttgccactggtttaactatggagttccagtttgggactaactggtcatatttctctcattacgtcggtgatatcttcggggcccctctggctatcgaaggtttaatggcgttcttcttggaatctacgtttgtcggtctattcttcttcggatgggatcgtctgactaagcatcagcatttagctgtaacttggctagttgcgttaggttctaacttctctgcattgtggatcttggttgcgaatggttggatgcaaaacccgattgcatctgatttcaactttgaaaccatgcgtatggaaatgctgagcttctcagaattagttctgaacccggttgctcaggtgaaattcgttcataccgtcgctgcaggttatgttaccggcgcgatgtttatcttgggtatcagttcttactatctgttgaaaggacgtgatattccctttgccaagcgttcttttgcgattgctgcaagttttggtctggcctccgtattgtctgttatcgtcctgggtgatgagtccggttacgaaatgggtgacgtacagaaaaccaagttagccgcaattgaagctgaatgggaaactcagccgcctccagcagcctttacgctgtttgcgatccctaaccaggaaaccatggagaaccggttcgccattcagattccatatgcattaggattgatcgcgacccgttcactggataccccggttatcggtttgcgtgacttgatgtcgcaacatgaagtgcgtattcgtaacggtatccaggcgtatagtttgttagaacagttacgtggtggtaacactgaccctgctgtacgtgatgcattcaataaagcgaagcaggatcttggttacggcatgttgcttaagcgttatacggaaaacgtagctgatgcgactgaagaacaaattcagttagctgctcaagactctattccgcgcgtactgccgctttatttcgccttccgcatcatggtggcctgtggcttcctgatgttgctgattattgggctggcgttctataacgtggttcgtggccggattggtgagaaaaaatggcttctgcgtgccgcattgtatggtattccgttgccgtggattgccgtagaagcaggctggtttgtggccgagtatggccgtcaaccttgggccatcggtgaagtattgccgacagcagtcgccaactcatcagtcactgccggggaaatactgttctcgatggcgttgatttgcggtttgtatacgctgttcctgattgcagaaatgtacctgatgttcaaatttgcgcgccttgggcctagcagcctgaaaactggccgctatcattttgaacagccgactgccccagtgcaggaagcacggtaaacaggagtccacttatgtttgattatgaagtattacgatttatctggtggctgctgatcggtgtgctgctgattggtttcgcagtcaccgatggtttcgatatgggtgtgggtatcctgctacgtatcatcggtaaaaatgatacagagcgccgtatcatgattaactcgattgctcctcactgggatggtaatcaggtttggttaatcacggcaggtggggcactgtttgcggcctggccaatggtctatgccgctgcattttccggcttctatatcgcgatgattctggtgctggcagccttgttcttccgcccggtcggttttgactatcgttccaagctggagaatagccgctggcgtaacatgtgggactggggcatctttatcggtagctttgtgccggcagtcgtctttggtgtggcttttggtaacttgctgcaaggcgtacctttccacatgaatgagtatatgcgcctgttctacaccggtaacttcttccagctactgaacccgtttggtttgttggccggtattgtcagcttgaccatgttggtgacgcaaggcgcgacttacctgcaaatgcgtacgcgtggtgaactgcaccttcgttcccgtaaggccgctcagatctcggctctggtaatgagtgttgccttcttgctcgcgggtatctggttagttaaaggtattgacggctttgttatcacttcagtattggatacagcagctgaatctaacccaatgcgcaaagaagtggctcatcaggccggtgcatggttgattaacttcaacaagtatccaatcctgtgggctttacctgcacttggcgtgattttgccactgttcaccattttgttgtcacgctttgaaaaaggggcatgggccttcttgttctcatcactgacgattgcttgtgtgatcttgactgctggcgtaaccatgttcccgttcgttatgccatcaagcacgatgccaaatgtcagtctgaccatgtgggatgcgacatctagcctgttaacgctgaaagtgatgacgattgttgcgataatctttgtgcctatcatcctgctttacaccagttggtgttactacaagatgttcgggcgcattgataaagaatttatcgaaaacaacaagcattcactgtactaaggagcataaagcatgtggtattttgcctggattctagggacacttctggcctgctcctttggtatcatcactgctctggcattggagcagagtgaagccaacgcagcagctaaagccgctaacaatggcaacgacgatgctgtctgataagttgtacgaattaatggataagggcccattgagggccctttcactggtgctcgcgtttgcgctggctttctgtgtgttttgggaccctacgcgttttgcggcggccaccagctcactggaagtatggcaggaagtctttatcgtgtgggcggtgtgcactggtgtgatccatggcgtcggttttcgccctaaacaggtgtggttgcgtgctttttttgcaccacttcctgcaattgtgatcttggctacaggattattctactttttcgcctaatcttccttgagcacaatcctacctatgggccatccggcccataattattttcgttctattctcgcaagtgattccaaagctcaacgctcttcagtatagtgtgttcgttaattgcattactgggaagtagagtgagtaatacgttatttcgatggccggtacgagtctactttgaagataccgatgctggtggcatggtttaccatgcgcgctacgttgccttttatgaaagggcgcgaactgaaatgttgcgccaacgaaattttcatcagcaacaattgctcagtgagcatgttgcttttgctgtccgcagcatgacggtagaatacctggctcctgcacgtcttgatgatatgctggaggttcagagtgaagttaccgctatgcgtggtgcctctctcacgtttgctcaacgaattctcgactcacatggcaatcttctgagtagtgcagaagtattgatcgcatgtatcgatccacatcaaatgaagccaagagcgcttcctaagtctattgtcgcggagtttaagtagtggctgacatgaacattctggatttattcctgcaggcaagcctattcgttaagcttatcatgctggttctgatgggcttttctattgcgtcatgggctatcatcattcaacgaacgcgaattctgaatgcggctacccgcgatgctgaagccttcgaagataagttttggtccggcattgagctttctcgcttgtatcaggaaagtcaggctcgtcgcgatacacttagcggctcagagcagatcttccattctggtttcaaagagtttgcccgtctacatcgtgcaaacagccatgcaccagaagcggtgattgacggtgcttcccgtgcgatgcgcatttcaatgaaccgcgagttagaagcgttggaaactcatattccgttcctcggtactgtcggttcaatcagcccgtatatcggtctgtttggtaccgtatgggggattatgcatgcctttatctctctgggcgccgtcaaacaggcgacattacagatggtagcaccgggtattgcagaagccctgattgcgacagcgatcggcctgtttgctgctattcctgctgttatggcctataaccgtctgaatcagcatgtgaataagcttgaacaaaactatgacaacttcatggaagagttcattgctattctgcatcgccaggctttcgccagcaccgaaagcaaataagtagggggttatatggcgcgagtacgtggtcgtaagcgtcgcgagcttaagtctgaaattaatattgttcccttactcgacgttttgctggtgctgttgttgatattcatggcaaccgcacccattatcacgcaaagtgtcgaggtaaacttgccagatgcgacggattcaaaaacggtatccagtgatgataatccgcctgtaattgttgaggtttccggtgttgggcaatatacagtagtcgttgatcaccaacggatggagctgttgccttcagagcaagtggtggcagaagctcaagcacgattaaaaacgaatccgaaaaccgtgttcctgatcggtggcgcaaaagaggtaccttatgatgaaattattaaggcgctgaatatgctgcatcaggcgggtgttacatcggtgggcttaatgacccaaccgatataaatttgcgttgatattggttgggctaatcgttagctcaacccgtagataccctgtttttagcagttccgttttttagcaatagagcgcggacatcgagtgtggaaatcgagcgtgggtaaggcaaccgagcaaaatgataagctgaatcgcgccgttattgtttcggtggttctgcacatcatattgattgccctgttgatttggggctctctgacgcagacgactgaaatgggcggtggcggtgctggcggcgaagtgattgacgctgtaatggtcgatccgggtgcggtgacagagcaatataatcgtcaacagcaacagcaaacagatgctaaacgtgccgagcagcagcgtcagaaaaaagctgagcagcaagccgaagaattgcagcaaaagcaggctgctgaacaacagcggctgaaagaattagaaaaagagcgtctgcaagcgcaagaagatgcgaagctggctgctgaagagcagaaaaagcaagttgctgaacaacaaaaacaaatcgctgaacagcaaaagcaggccgctgaacaacaaaaaattgctgctgctgccgttgcaaaagcgaaagaagagcagaagcaggctgaaacggctgcggctcaggcaaaagctgaagcagataaaatagtgaaagcgcaggctgaagcacagaaaaaagccgaggctgaagccaaaaaagaagctgctgttgccgctgcggcgaagaaacaagccgatgccgatgcgaagaaagcggtagaggttgccgaaaaggctgcggctgacgcagcagaaaagaaagcggccgcagatgcagagaaaaaagccgctgctgctaaaaaagttgctgccgccgctgaggccaagaaaaaagcggcagcagaagcggctgcctcaacggatgttgatgatttgtttggtggtttggcaaacgctaaaaatgcaccgaagagtggttcgggtgcaggtgccgctgctgccggtaaaggtggcggtaagaaaagcggggcatcaggtgctgatatcagcggctacctggggcaaatcaccggcgcgatacaaagtaaattttatgatgcagatctttacaaaggccgtacctgtgatttgcgaatcaaattggcaccagacggtctattaatcgatgtgaaagcagaagggggggacccggcactgtgccaggctgctatcgctgcggcaaaacaagcgaaaattcctaagcctccaagtacggatgtctatgaacaatttaagaatgctccgcttgtgtttaagcctcaataaggtttgattgacagggtgtaacgttgttagttaatgatggatcatgtagttttgtttgcggtggtttgttaaaattctgctaattatcgcgggcatcccgctcgggtaagggagataaaatgaagcaggcatttcgagtagcgctaggctttttagttttatgggcttcggtattacatgcagaagttcggattgagattacccaaggggtagactcagcacgtccgattggggttgttccgttcaaatggatggggccgggcacaccacctgaagaaattggcgccatcgtaggtgcagatttacgtaacagcggcaaatttaacccaattgatgctgctcgtatgccacaacagccttccacagccgctgaagtaacccctgctgcttggactgctttggggatcgatgccgttgttgttggccaagttcaaccaagtgctgacggtagctatgtggtctcttaccagctagtggatacttctggctctgctggcagcattttggcgcaaaatcagtataaagtgactaaacaatggttacgttattcagcgcacaccgtcagtgatgaagtatttgaaaaactcactgggattaaaggcgctttccgtactcgcattgcttatgttgtgaaaactaacggtggtaaattcccacatgaattacgggtttctgattacgatggctacaaccagtttgtcgtccaccgctctcctgaacctctgatgtcacccgcttggtcaccagatggtagcaaaattgcctatgtgacttttgaaagtggcaaatcagcattggttattcagacgctggcaaatggtgcgattaggcaagtggcctcattcccacgtcataacggtgcacccgcgttctcacctgatggcaccaagctggccttcgcgttatctaaaagcggtagcctgaacttgtatgttatggacttggcttcaggtcaaatcagccaagtgacggatggtcgtagcaataatactgaaccaagctggttcccggatagccaaaatctggcttatacctcggatcagggggggcgtccacaagtttataaagtgaatattaatggcggtgtgccacagcgaatcacgtgggaaggttctcagaaccagaacgcagacgtgagccctgatggtaagttcctggtattggttagttccaatggtggggcacaacacatcgccaaacaggatctggaaacgggagccgttcaagtattaacggacacgttactggatgaaacgcctagtatcgcgcctaacggcaccatggttatctatagctcgacacaagggctgggttccgtgttacagctggtctcgactgatgggcgtttcaaagcgcgtcttccggcaactgatggacaggtcaaatttcctgcctggtcgccgtatctgtgatgcatgtgtaaatacgtatgtatggcaaactataaaaaaggatcaaagagatgcaactgaacaaagtgctaaaagggctaatgttggctttgcctgttctggctgtggcggcttgtagttccaacaaaagcgcaaataatgaccaatctggcatgggcgctggcactggtacagagaacggcagcaacctgtcttctgaagagcaagcacgtcttcagatgcaagaactgcaaaagaacaacatcgtttacttcggtttcgataaatacgatatcggttctgacttcgctcaaatgctggatgcacatgctgcattcctgcgtagcaacccatcttacaaagttgttgttgaaggccacgcggatgaacgcggtacgccagaatacaacatcgctttgggtgagcgtcgtgctagcgcagtgaaaatgtacctgcaaggtaaaggcgtttctgctgaccagatctctatcgtttcttacggtaaagagaaaccagcagtactgggccatgacgaagcagcctttgctaaaaaccgtcgtgcagttctggtttactaagagaatcgcatgaacagtaacttcagacgtcacttagtgggtctgtcgttactggttggcgtagcggtcccatgggccgctactgcccaagcgccaatcagtaatgtcggctccggctcggtagaagatcgggtcactcaacttgagcgtatttccaacgctcacagccaactattaactcaacttcagcaacaactgtcagattcgcaacgcgatgttgatagtttacgcggtcagatccaagaaagtcagtaccagctcaatcaagttgttgagcggcagaaacagatctaccaacagatggagagtctgagcggtggccaaggggcgcagaattcagcttctgcggcgagtggtgcaacagcagacaatacagcggctggaagttccggtaatgccgacgcaggcgcagcagcttctacagcggcaccagcagcaagtactggtgatgaaaacagcgattacaatgtggctgtctctctggctcttgagaaaaagcaatatgatcaagcgatcactgcttttcagagttttgtgaaacagtatccaaaatcgacttaccagcccaatgccaactattggttagggcagttgtattacaacaaaggtaagaaagatgatgctgcatattattatgctgttgtcgtaaaaaattatccaaaatccccaaaaagttcagaagccatgtttaaagttggggtgatcatgcaggataaaggccaaagcgataaagcgaaggcggtttatcagcaagtgatcaagcaatatcccaataccgatgcggctaaacaggcacagaaacgtttatctgctctttagcttttttgagcccaggatttagtcaatttgactgatttctgggctttatcgtgtgaagaacaagcagttaaacatttcagtagaaatttaagttgcactgtgatgataaattagtaatatatgccgccgttgccaagacaactgtaaaacgttaaggcagtaggaaattattgtcagcagtacaggtaatgggtcgttagctcagttggtagagcagttgacttttaatcaattggtcgcaggttcgaatcccgcacgacccaccattacctcaagaattaccgcatgacagcgggtcgttagctcagttggtagagcagttgacttttaatcaattggtcgcaggttcgaatcccgcacgacccaccatcatgtcaagaattaccgcctcacagcgggtcgttagctcagttggtagagcagttgacttttaatcaattggtcgcaggttcgaatcccgcacgacccaccattacctcaagaattaccgcatgacagcgggtcgttagctcagttggtagagcagttgacttttaatcaattggtcgcaggttcgaatcccgcacgacccaccattacctcaagaattaccgcttcacagcgggtcgttagctcagttggtagagcagttgacttttaatcaattggtcgcaggttcgagccgagcagagcgagacaacaacgcgccagcgttgacccgaagggcgagtccagaggacgagtcatcccgcacgacccaccatcatgtcaagaattaccgcctcacagcgggtcgttagctcagttggcagaacagttgacttttaatcaatgggtcgcaggttcgagccgagcagagcgagacaacaacgcgccagcgttgacccgaagggcgagtccagaggacgagtcatcccgcacgacccaccatcatgtcaagaattaccgcatgacagcgggtcgttagctcagtgggcagagcagttgacttttaatcaattggtcgcaggttcgagccgagcagagcgagacaacaacgcgccagcgttgacccgaagggcgagtccagaggacgagtcatcccgcacgacccaccattatttccccaacacacatatctcttaacttttcatcttcccctactctcgggtatctccattttagctttagccctataatcctctggtttctttcctcactctctactgatacgtgaattatcacctcgtttttaactctattaaacattttcgctattaatcgacaaattttggcgactttttgccaaatattggttattttgtttaggataaaaaacaaatcaattcaattcttactgggtggctagcagcgatctgatagcttcagtaataccacagcaacagagatgtgagcgatgagcgaaatttttgatgtgaatgcggctatttatcctttcccggcgcggcctgttccgttggacaccaatgaaaaagctttttatcgtgagaaaataaaaacactgttaaagcaacgcgacgcagtgttagtcgctcactattacactgatcccgaaattcaggcactggccgaagagacggggggctgtgtcgccgactcacttgaaatggctcgttttggcaataatcacccggcatcaacgctactggttgctggtgtacgttttatgggggaaaccgccaaaattctcaatccagagaaaaaagtgttaatgccaactctgaatgcggaatgttcactggatttaggatgcccggttgatgagtttaccgcattttgtgacagccatccggatcgcaccgtggtggtgtacgccaacacctcagcggcagtaaaagccaaggcggattgggttgtaacgtccagtattgcggttgaattaattgagcatctcgatagcttgggcgagaaaatcatttgggcacctgatcgccatttgggcagctacgtacagaagaagagtggtgccgatgtattgtgctggcagggggcctgtatcgtccatgacgagtttaaaactcaggcgctggcccggatgaaagcgttataccctgatgccgctgtgttggtccacccagagtcaccacaggcggtggtggatatggctgatgccgttgggtcgaccagtcaactgatccaagcggcgaagacactgccgcagaaaacgttaattgttgccaccgatcggggcattttttacaagatgcagcaggcctgcccggataaagagttgtttgaagcacctactgcaggtgaaggggcgacatgccgcagttgtgcccattgtccatggatggcgatgaatggcctccgagcaatcgctgaagggctggagcagggtggggtgatgcatgagatacatgtcgatgaagaattgcgtcagcaggcgctgataccgttaaatcgcatgctggattttgccaatcaattgaagttacaggtcaaaggcaatgcctgagtaactggtgagaatattcattcggcgcctcttggcgtcgtgaataatcacctatcatgagatgagcaagagacttttattttaataaatcagttctatcggcagctaaaaggatcaccagatggattttctcagcacaggcaacatattggtacatataccgctgggggcgggcggttacgatctttcatggatagaggcaattggtaccctattcgggttgctttgtatctggtttgccagcaaagaaaagatcatcaactacttatttggtctgattaacgtgacattgttcgccgtgatcttctttcagatccaactctacgccagcttgttattacagttgtttttctttggtgccaatatttacggctggtatgcctggagcaaacaaacaccggataatcaggctgaattaaagattcgctggttatccttgcctaaagcattggcttgggctgcagtttgtattgctggcatcgtattaatgacattgcatattgataccgtatttgcctggttgacacgtgtagcagtgacggtgatgcagagtctgggggcgaatgtacagatgccagagttgcaacctgatgctttcccattctgggactcgacgatgatggtcttgtctattgctgccatgatcctcatgacccgcaaatacgtagagaactggctgatttgggtcgttattgatgtcatcagtgtggcgatctttgcctatcagggggtttatgccatggcgctggagtatgcgttcctgacccttattgcattgaacggttcttggttgtggatcaagagtgctgcacgaaatcattcacgcccactgtctactcaaggttaataacgactcggctcacctgcgggatagcataaatacggttcaaatcagttcctgattcggtttcgtttactgcctgcagcaacaataactttgggtatatgactgtgtcagcggttattcgtggtgatgatgacggtgatgtccgtcggcaggggccgcttgattgataccacaatccggtgttccacaatgctgatactccatttgaactgtggcatgactaatgcggtagtgatgcagtaaatagtcttggatgcgttgtaataacgcatcatgatccagtggcggtatcacttgggcatgaagggtcattagccgttgttcacccacttgccataagtgaacatgatgaatgttccggacttcataaatattggtacataggtctttacgcagcttgttgatatcaatctcttgcggcgcaccctccaataattcgtgaaaactttctttcagtaatcgccaggcgttacgcaaaatcagtaccgacaccaataccgagagaatggggtctattggtgtccagcccgtggttaaaatcacgatagccgcaatcatcgcgcccactgaacctaataaatcacttagcacatgcaaggctgctgcccgtacattgatgtttttctcttcttctcccttatgcaggatccaaaaacaaaaaatattcgccaacagtccggcgatagcgatgattaacatcggggtacccatcacctcatgaggtgaaaagaagcgatgaacggcctcccagacgatcaatataacaatcagcaataatgccgctgcgttaacaaaggccgcgagtgtcgtcagccgtaggtagccaaaagtatggcgggggtctggttttctctgggagaagtgtactgccatcaacgcgataaataatgctgcagagtcggtcaacatgtgtccggtatcagccaataatgccagagaaccagataaccagccgccaatcgcttccgtcaccataaataatgtggtgatggcgaaggctatcaataggcgtttgctgttgctatcttgcgagaaaattgcggatacagccattatttatcctttgtttccatcacggttttattgtgcaaataggcgcaagctatgttttttctacaggctatgttttatctacaagctatattttatctacaagctatgtcctctccacaaggcatactctatctagaattccgtggattagttattcccaatagacatcgtcgttgagtataggccccaggttcgaatttgcctcagttggcaccggtttactcctatatacccaagttacttcgagatgcaggtaggcggcaaccgagtaaatcgccgggagcttagatagctaagtgactagggtgagcatgggtaattgtttttgggaaccggtcgatggcattgcgactaatctgcactgaatagcgaaagcgataaagtagatttacagcattccattcacaggctagattggttcaaatatatattgtgcaatgatcgctaaagacttaatggaagaactatgaattaccagaatgatgatttacggattaaagaaattaaggaactcctacctcctgttgcgttgttagagaaatttccctccacagttaatgcggcagaaaccgtcgccaagacccggaatgctattcacaacatcttgcgtgctcaggatgatcgcttgctggtggtgattggcccatgctctattcatgatacgcaagcggctaaagaatatgcggcccgtttgctggcactgcgtgaagaactgcagggcgagctggaagttgtcatgcgtgtttattttgaaaagccgcgtacaacggtgggttggaaaggcctgattaacgatccgcatatggacaatagctacgacatcaatgaaggtttacgtctggcgcgtgaattactcgtcgaaattaacgacagcgggttaccggccgccggtgagtttttggatatgattacgccgcagtatctggctgatctgatgagctggggagccattggcgcacgtactactgaatctcaggttcaccgcgaactggcttctggtctgtcttgccccgttggttttaaaaatggtaccgacggcaccattaaagtggctattgatgcgatcaacgcggccagtgccccacactgtttcttgtcggtgaccaaatggggtcattcggcgattgtgaatactgccggcaatggtgattgccatatcattttacgtggtggtaaagagccgaattacagcagtaagcatgtgaatgcggttaaagaagggctgattaaagcgggcctggaaccccagattatgatcgatttcagccacgctaacagttgcaaacagtttcaaaagcagatggaagtgggaacggatgtttgccaacaaattgcgcaaggtgaaaaatctatcataggcgtgatgatcgaaagccatttagtcgaaggtagccaaaacctggaaagtggtgaaccactaacctatggccagagtattaccgatgcctgtattggctggaaagatactgaggcgctgttgcgccagttggctggagcagtgagagctcgccgccagtaggctaacgcgcttgctattttgagtctgggcaggtgcgttatcttcacgtacaactcgttatcttcatatacagaagagtacgctttggtaacggagtgctgactgcattcacatagccgtcaataaaaaaccccgacattattcatgtacggggtttttttactgtgttaatcagggctaattacttcgctttaccctggttagcaaccgctgcagctttagcggcgatttcatcagcgttacccagatagtagtgtttgataggcttgaagttctcatcaaactcatacactaatggcacgccagttgggatgttcagctcaagaatttcgtcttcgcccagatcatccagatattttaccaatgcacgtaaagagttaccgtgagcagcaataattacgcgttcaccgctggcaatacgtggtttgataacgtcattccagtagggaatcacgcgttcaatagtcagcgccaagctttctgtggttggcagctcagcatcagtcaattttgcataacgtgggtcatggcctgggaaacgctcatcgcttttctccagtgctggaggggtgatggcaaagccacgacgccattgcttaacctgctcatcgccgtatttttcagcagtttcagatttattcaggccttgcagtgcgccgtagtgacgctcgttaagcttccaggttttttctgttggcagccatgcctgatctaattcatccaaaatgttccacaaggtgtggatagcgcgttttaatactgaggtgtaggcgaaatcaaaagtgaagccttcatcttttaacagcttacccgctgcctttgcttcagaacggcctttttcagacagatcaacatcataccaaccggtgaagcggttttcgttgttccattgactttcgccgtgtcgtaccaaaactagcttagttactgccataacgttgactccaattaagtttggtatatgcccgtcatacttcaagctgcatgtgcgttggctgcgctcaatcagccgaatcacttactccagtaagctcattggaactctctcgcttgccgccttcctgcaactcgaattattttgggtaataaatacacattcaatgataattattatcattatattgcgtgatcactgcgaacagcaatcgattgtgtttaaccatagccaattttttactttaacgtaagaccaatagccgaatcgattctgccaaataggcaacttatcaatatatgggcattaaataccccatatcaacagacccctgcctcgaaatgggttaggccgctttcttgaggcaagtgctcataaaggtcttgcgctcatcaccttttagcattttttgggctgcctcggcattacaacttttcattttctgttgctgaggtgtcagggcttttccatcaggtgctgtctgtgctttcagacattgactcataaagtttttccgctcatcacccttgagtgattgagtgctggcctgttgattacaatcggtcatcttctgctgctgcgccgcttgggctggtgagggcgttttcggcggatctgcggccatcacattggcactcagcaataacccagccgataacaaccatagggggaatagacgcataggcgttcctttttatagtcatgaggtttagtaatcaatgtcagaggtctaaaaggcgggcagaacgtcagtacggccgcctgacagatgcagttaagcgtagtcggcagcagtgaataagggtagttttaggcaaggattcagttatatcttagaagatgaatgagcacgatattagaaagttaacggccactaccgaagtgagaaccgggtggccgttgcggcatgatgtattacgccaggagtattcgtaatacatcattcataacgtcatcattcataacgtcatcatttataaaggcaacgcaataaagtgataaaccgtcgttgagcgataggtcttccccggttttagccaacaatcgggctgtggccattcagggtggttagggctatcaggcaaaaattcactttctagtgccacacccgcatagctggcataggtgccgccgttgcgtgcgggtgtgccagcaagataatttccgctgtaaagctgcaacgcaggcgctgaggtgaacatactcatttgcacctggttatcggatgaccacaagtgtgccgccggagagtctaaggccccacaggtgcggtgcagcaaataagcgtggtcatagcctttaactcgttgctggcagcgatcttgtagaaaatcctgcgccaatgttttaggttggcgaaaatccataccggtattctcgacatcagcgagtcctccggttgggatgcccgcactgtcgacaggcaggtaacggtctgcaaacagttgcaaacgatgtgaacgggcatcatgcccttcgccgtcaaggttgaaataggcatgattggtcaggttaaccgggcaggttttatccacctgtgcctgataatgaatttccagccggttatcttcggttagcaggtactgtacttcaacagtcagattaccggggaaaccttgatcgccatctggtgaatcaagtttataggtaacctggtggtcatcttgggtcactttctgccaacgctgggcatggaaaccctccgggccaccgtgtaattggttagggccttggttcgggaccaactggattgtttcgccatccaaggtgatttgcgcattggctatccggttggcataacggccaaccgttgccccgagataagcggcttgatgcaggtaatcagccggtgtcgggcagcccagcagcaattcacgttgctcaccatttttcagcggtaatatggccgataaccaggttgcaccccaatccataaaggtgacggtcataccggttttattctgcaatttggtgagttcaaaagggtgaccatccggtgctaacgagtcaacactgtttggtgatgccgcgccgtttttcagcataaacccgctccttgtgaagcctgacagacataaaaagtctctttcttgccgccgctgtgtgccgggtattcctgcgcaacggtggtgcgaacctgctcgactaattcaagtggcattaaggcgacaatacaaccgccaaaaccgccacccgtcatgcgcaccccaccttgatcaccaatcactgatttcacaatctcgacgagtctatctattggcggaaccgtgatctcaaagtcatcacgcatagaaatatgagactcttgcatcaattgccccatcaatttcaagttcccggcggccaaggcatctgcggctgctagcgtgcgtgcattctcgctgatcacatggcgggcgcgtttagcgacgaccggatctagctcgtcttgtattgagaagaagaggctcggttcgacatcacgcaatgctttgacgccaaagaaacgggcggcagcttcacactgttggcggcgagtattgtattcgctgtcaaccaggccacgttgaatgtttgagttgataataacgacggccatgttttccggcattggcacggcacgggtttccaaggtccgacaatcaatcagcaacgcatggtcttttttacccaatgctgagattaactgatccataatgccgcagttacagccgacaaattggttttctgcctcttgcccattcagcgccagttctacaccgctaagagggagttgatagagtgattgcagggcttggcccacggccacttccaacgatgcagaggaactgaggccagcaccctgcgggacattgccacagataaccagatcggccccaccaaaatcagcgttgcgcatttgtagatgtttcaccacaccacgcacgtagtcagcccagcgatattcaggatgcgggacaatcggtgcatcaagagagaatatatcctgctggttttcatagtcggcggcaataacacgaatctggcgatcgccgcgtttgccacaactgatcaccgtttcataattaatggcgcagggcagaacaaagccatcgttatagtcggtatgttcgccaatcagattgacgcggcccggcgctttaatggtgatgtcagactcgcggtcaaactgttggcggaaaatagtctgggtatgttgttttaaactcatgatttggctccggcctctttatagtgaacatcacttactgcccgcaggagtgctgccgcctgttctgctgtaaggtctcgctgggtttcggccagcagttcatagcccaccataaacttacgtactgacgctgaacgcagcagagggggataaaaatgcgcatgtaattgccaatgcgtattgtcattcgcgttataaggcgcgccatgccatcccatagagtaagggaaagagcatgagaataaattgtcataacggctggtcagttttttcaaggcaatggccaaatcactgcgttgctctgccgaaaggtcttccaggcgcaatactgcggctttgggcagtaacagggtttcaaatggccaggctgcccagtaaggcactaccgctagccaatgttctgtttcaaccacggtccgttgaccatcgcggcgttcccgctcgacataatccagcagcatgggcgattgatgttgctgaaaatactgttgctgtaaacggtcttcctgttctgcttcattcggcaggaaactgttggcccaaatttgcccatgcggatggggattagagcagcccatcgctgcccctttattttcaaacacttgcacccatgggtatattttgcccaactcggcgctctgctgctgccaagtctgaacgacctgttccagcgcgggcagtgtcagttgcggcagggttttgctgtgatcaggagagaagcaaatgactctactggtgccgcgtgcgctttgactacgcatcagcggatcatgacttggcggcgcatctggggtatcaggcatcagtgcggcaaagtcattggtaaagacataagtcgatgagtaatcaggattcacatcaccggtaactcgggtattgccggggcacaagaagcaatcgggatcatgagccggtaaattctcggttgcgggtgcttcttgttggccttgccatgggcgtttagcccgatgaggcgagaccaatacccactggtctttcaacgggttatagcgacgatgtggatgatccacagggttaaaatgcgtcataaaattgccttaatcggggtagccttgaggattttttgattgccagtgccaagtatctgccgccatctcatcaagtgagcggctgactcgccagcctagttgttccgccgctttagttgcatcagcccagtaggcaggcagatccccttcgcggcgcggggcaaaatggtaggccagtggtttaccacaggctttactgaatgcggccaccacttgcaacacactgtggccgacaccggcccccagattgaagatatgcacgccgggcttgccgtgtaaggttttcattgcggccacatggccgtcagccagatccaccacatggatatagtcacggacgccagtaccatcaggggttgggtagtcattgccaaagatggccagtgattcacggcggccaacggcgacttgagcaataaacggcattaaattattcgggataccttgcggatcttcgcccatcaaacccgatgggtgcgcaccgacggggttgaaatagcgcaaaattgtcatattccactgtggatcagccagttgaacatcttgcagaatttgctcaaccatcaatttactgcggccataggggctggacggtgaaccggtcgggaagctttctacatagggaatctgtggctgatcgccataaacagtggctgaggagctgaaaatcaggttcttaacctgtgcggcgcgcatcgcttctaataacaccaaggtgccaaacacgttgttgttgtaatactcgagtggccggttgacggattcgccaaccgctttcagaccggcaaaatgaatgacggcatgaataggatgagccgcaaaaatgctatcgagcagtgtgcgatcacggatatcacccgtataaagttcaggcgtatagccggtcaaactgtgtatccgggctaatacgctggatttactgttgcagaggttgtcgaggatgacgggtttgtagccagcctcaatcaattgcacacaggtatggctaccaatgtaaccgctaccacctgttaccagaacgtacataataagactcctctaatgagttcaatgcaataaagatagcacgccattatgggtaaaaaggtgatctacgctcaataatggaatcgtttacactcaattttttactagcttaatcccactgaatacagaaatacaggggtattctgtgagcatagacaaataatggtaaaaatgatgggcataacaacgattgctgaagtggtagcgttctcatccatcaatgtagccggaatgtcctgtttgtggtgcgcgaggttgctgctcacgaggttactgccataggttgataggtcaatttatcttgatgtcagtcaccaatgggcgatgacttaatcgcggtagtgatccctttggttcatttagtggggtaaatagagtggataggtgaagaacagtaaatgcattaaattcagggcgaaatggaaagccacggcaacccacaggcggccactccatagccaggccaagccataaataacacctgccagtgcggcgaataacattaatagcgggccaccggcgaagtgagcactgccaaagagtaatgcggtgatgaccaacgctgggtaagacccaagccactgaccgaggcgttgttgcaagtagccacggaataaggcttcttcagccagacaaacaaaaaacagattggcaataataaaggagcctatccaaaccggggtatgcagctcaattttcaagccaccgagcgccacagccagcagcaataaggcgggtacgctgagtatcagcacaacccaacccatgcgcccgactgatgggtgttttttcaccttgaacagggttggcagacaggccagtaagataaaggggactagcgccttatccagattgtaatacatggtgaagggggcactgagcggcccggtacggactttatccagtactttcaggttgtgaaaaccaggaacaaggtgcaggaataacgcgataacgcccagcacgagcagcaactccaacccagcggcgacgccattacgttgacgatacttttgcagcagtagcacgaggatgattatggcaagtaaaaacgcggtagcagggaaggtgaggacaccgctataacaggccattgctaatgatgaaaccaaaaataacagggagagcacctggctcagtggtaaaaacagtaacgaagtagcaagaacaccccacatagataatccctttcttatttcatcctgattgatggcatagccctaaatgacggtttagcctaaggcatttttttgagctaaatcaaccaatttacacttggccaccagcactgataagtggctggtggtaagaataataacatgctggcaccagagtaaaggtcgggtcagtgggggttgcattgggtgacgctcagttaaaactgtgaaaaatgcttattttacctgtggttggcttggtaatttttcttgttgatagtgataaatatcgccaaatggcacaaaggttaagcggtgcgtaatacactggggtgcatcctcggcatggtgagaaacgaacaataattgggtttctccttcaccgatcatcacatcaataaaacggcgcactaacaaacggttaagcggatccagcccttgtaatggttcatccaggatcaggagcgctgggtgcttaaccaatgctcgggcgatcaagaccagacgctgttgcccccaagataagctgtggaaaggttggttggcgacggaggtggaaaaccccagtaaagacagccattgatctgctaattgttgttgacgatcagaggctgcttggtaaagaccaatcgaatcgaaaaaaccggataaaatcacggtacgtacacgggtgctaacccggtagtccagatggaggctgccgctgacataaccaatatggcgtttgatgtcccagatggtttcaccactgccacggcggcggccaaacagcgttaaatcattactgtatccttggggatggtcgccagttatcaggctgagtaaggtggatttccccgcaccattctggccgataatctgccagtgttcaccggggttcacttgccagctcaggttatgcaggatagggcggtcgttgtactccaccaccccgtcattcagtatgatcaagggttcatttttcggtattcgtaggtggtgctgtggatcctccgtttccggcagtgacagcccatccagattttcactgtgtgccaattgggcaattaacgcttccgacagaatctgctggcgcggccccatgtgggtcaggtggcaatcagccaatacgccaacgtactgcacaaaatcagggatatcatcaaagcggttgaggaccaataccagggtgacgccttgggccgaaagtgtggatagcatctcggctaactgcgcccgagccgcgacatccaggccatcaaagggctcatccagaatcagcaggtccggttgcggcatcagcgcctgacacagcaatgttttacgggtttcccccgtagaaaggtatttgaagcggcgagaaagcaagtggctgattccaaatagcgctgccagttgttgacagcgctgcgggtcacgggccgcttcctgaataatttcggcggtagtacggccagtgtcatcttcatcagcactgagcaggtcggtattattacgttgccactcttcattgaccagttgctgtagttgttcgaatgataaacgcacaccatggcggaagtggctttggcggctgccctccagcagggccagttctccagacagggccttggctaacgcagatttaccactgccattggccccgacaaatgcccaacagtcacccgcctggatatgtagcgctggcaagatgagtgtctgtgtgtcactcaggcgaaaacaaccttgcgatatttgcaactcagacatcatctttcccatattttgcaacgtagtaaagatgttagggataagcggaaagacgaaaaatgtcaacgaacaaatgtatggtccaacagtgattactgggaataatcattcaacacaatgtggcgataatcacccgatctgcattgaattgtgcaatgacggcactgccaacccgtaaattcagcgcatggagttcgctgttgttttgggttgaacacaggttggccccgccagttaaggtgacaataacttcgctatgatcgttgcccggctcaatgctggcgaccgttcccggcaatgcgttatccgctgcacctgccagtgccggatcggtaaccagttttacccaaggtgctttaatcaatgccagcacttctttacctgctgaaagttgcaggcgatccgcgctttgttgggtgatcgccgccgttaagcgagttttaccgtccgatagcagaatattgacatgctgttgcacctgctggtggtcgcgttcaataagggtaccgaaaaattgattacgggcgctggtttgcagtgaaaaacgggaaattgccgccagcaagctgtccagcggcagtgaatcatctttcagggtatcaaaggctttttgctggatggttgcgagtaaatcataaagctggattaagcgttcaccgtagcgggtcagatgtgcaccccctccacctttgccgccagtggcccgttcaaccagtatctcctcggacagtgtattcatgtcatttatggcatcccaggcacttttatagctgatacccgcgagcttggctccctggctgatggaaccggtatgctgaatttgctttaacagtgcaatacggcgtggatcggcaaacaggcgctgttgaagttttagtgtaagaagaatttcggcctgcattgttttttgctccggcgggaaacagttattgtcatagatagctaaatgacatagatagctaaacaacatagatagataaatcgcacgtttggcaggttacatttttttatcgtcggttaaaataacagggttaattcattgctgatatcatttacagtaaatgataggcagcagtgttggttattgtgataatgtgggttatcgctcaatgggcagttatgagaggctagcatgtttgaactattaaaaagtctggtctttgccgtggtcatggtaccggtggtgatggcagtcattttggggctgatttatgggctgggtgaagtgtttaacgtgatctccaagacgggtcacccgaaagaacggaatacccttcgttcttgagtgttgctgtacgcttatcagcacaagcacacaagtctctgatttctgaatgcctggcgtataaacgttgggcatttttgtatcattcctcaccttaatcccccaccttagtttctcccacgatacggttacgactcaagctgcctcacatcttgccgataaactgcatgacctgcttataatgttacgctatattcctccgtatataacggtatcattaatgtggagaacaacatgaagaatcaatacggtaaagtgagttactgggtagccggtgcggtattgctgacggctttttccggcccagccttcgctgccgataagattaccgtgtttgccgcggcctcactgaccaatgcgctacaggatattgctgtccagtataaacaagaaaagcaggtcgatgtggtggcttcctatgcgtcatcttccacgctggcacggcagattgagcagggggcaccggccgatctgtttatttccgctgaccaacaatggatggattatgccattgataaacagcaaattgtcgccaatactcgctacaccctattagggaacgaactggtattgattgcgccgcaagacagccagattgataaagttgagatcgataagaaaaccgactggaaaaagttgctggagggtggccgcttggcggttggtgatcctgaccacgtaccggcgggtatttatgccaaagagtccctggaaaacttaggggcctggtcaacgttagccccggaaatggcccgtgccaataatgtgagaagcgcaatggcgctggtcgaacgggcagaagcgccgctgggcattgtttatggttcagatgcggtagccagtaagaaagttaaagttgttggcatattcccggaggcaagtcataagccggttgaatacccaatggcgattgttaaaggccatgacaatccaacggtaacggctttttatgattacctgaaaagcccggcagccgcggtgattttcaaaaactatggattcaccccacgctaatgatattgagtgagtatgaatggcaggcgattattctcagcctgaaagtttccggtgtcgcggtagcttgtagcctgccattgggtattctgatggcctgggttttagtgcgttgtcgcttccccggaaaatcgctgctagacagtgtgattcatttgccattggtgttgccaccggtggtgattggctatctcttgttgatcagtatggggcggcgcggttttatcggcgaatggctctatagctggtttggcattaatttcagtttcagttggcgcggtgcggccttggcttcggcggtggttgcttttcctttgatggtcagggcgattcgcttagctctggaggccgtcgatacccgtttggagctggcggcgcgcacgttaggggcaacgccatggcgggtctttttcacgataactctgccgctctctttaccgggggtgattgccggtacggtgctgtcttttgcccgctcattgggggagttcggtgcgaccatcacgtttgtttcgaatatccccggtgaaacccgaaccattcctctggcaatgtacaccctgattgaaacgcccggtgcggaagctgccgctgcgcgcttgtgtgtgatcgccattattttatcgttggtgtcattgctgttatccgaatggttggctaattggggtaaaaaacgcatgggggccccatgctagaactgaatttcagccaacaattgggtgatttacacctacaggtcgccaccgatttaccggcgcaggggattaccgcgatttttggtttatcgggtgccggtaaaacgtcactgattaatgtgataggggggctgactcgcccacagcaaggccgagtgattctgaatggccgggtgctggtggatgccgagaaaaatatttacctgccgccggaaaagcgccgggttggctacgtgtttcaggatgcgcgcttgttccctcattatcgggtgcggggtaacttgcaatacggtatggcggcgtcaatgcgcgggcagtttgacgcgattgtgggcttgctgggcattgagccgttattgaaccgcttcccgttcacgctgtcaggtggcgagaaacagcgggttgccattggtcgtgcattattgaccgctcctgagttgctgttaatggatgagccattggcatcactggatttgccacgtaagcgcgagctgttgccgtatctggagcggctggcgcaggatgtgaatacgcccattttgtatgtcagccacagcatggatgaaattttgcggctggcggatcaagtggtggtgatggatgccggtaaagttcgtgccgtgggggggctggaggaggtatgggccagcagtgcactgcggccgtggttgcaacgagaagagcctagcagcattttgcgggtgagtgtgattggtcatcatgatcgttatgcgatgacggcactggcgttaggtgaccagcggttgtgggtgggcaagttggatgccgctgaaggcaattcaatgcgtatccgtattaatgctgccgatgtctcactggcattacagccgccgcacagcagcagtattcgtaatattttgccggtaaaagtggctgagtgtctggatgtgggcgggcaggtcgatgttaagttagccatcggtgagcaatggttatgggcgcggatcacgccatgggcacgggatgaactggggctgaaacctggtcagtgggtgtatgcacagataaaaagtgtgtcatttaaccgccagaatggccctgtaccagattgagtggtgccgctttttgtgtaggcaccaccatgatgaatctgtcgctgtgaatttatcaggctaatacatgctggcggataacggcggcaatacccggttgctcgttatctgcaatcaccaggtccgcccgttgtttaatcgcatcgtcgctgttacccatggcaacccctaatccagcagcctctaacatactcagatcgttaaagttatcaccaaaagcgatcacctcttgcatactcaggccctgagattcaacccactgttggaggcgtttccccttgctgttccccgcttgggcgatatccacctgatcatgccacgaccattcgcaggccagacccatttctgcttctaccctggcggcaaacgcttttaactgtgcagtatctgggtgagaggtcgcaaatttccagatggcggtcgcactgtgagcggcatccagtaagctgttgacctgaagaaaggtcgggcgctgagcgggcggcaatgactcggcccaactgagggtgcgggtcacatggcccgtggtctgctgatacagcatggcatcatccacatacatcaggccatggatctgtgttttctccagtaattgcaggacttgaaccgcctgctgtggtgtgagcgggtttgaatccagcacttttttattttgataatcataaatataagtgccgttacagcagatagcgggcgtatccagttgcagtgcctgataaaacggatgaatcgcgacatggtggcggcctgttacgacgatcactttcacgccttcagcccgggcttgcgccagcgcggacaacgattcaggcaggatgcgttttttgtgatctaacagtgttccgtccagatccagtgcgattatgcgatatgtcatagcggtccctgtccccattaaaggggcgaatgagaaattatatgcttgaaaagtatgttccgatagtacaccggatgggcgattgattacaccaaaccgggggaaaggcctgtataaacagctaaaaagaagccgcgccgcgagatgcccgacagttgttatgtccgtgcagtcaggtaagctaggcttaaattagccgttaataaaagatatttggttaaggcgaaggggctggaacaggtcaattcaccttaatagcgttacccaacaggttcgactaaggagtaaagatgaagcaagcggtttacgtggcaagtccagacagccaacaaattcatgtctggcaattagattcagccggtgaattaaccttattgcaaaccgtggacgtgccgggtcaggtacagccgatggcaataagccctaatcagcgccatctgtatgtcggggttcgtcctgattttggtattgtcagctatcacattgccgatgatggtacgctgaccgccgcaggtatggcaccgcttcccggcagcccgactcacattgacaccgatcgacaaggtcgcttcttgttctctgcttcttacagtttcaattgcgtcagtattagccctattgatacgcatggcgtagtgcaagcgcccattcagcaattggatgacctgcccgcgccacattcggcgaatattgacccaaccaaccagatcttgctggttccttgcctgaaagaggataaggtacggctgtttgatttgagcgcggaggggcagttaaccccccatgcacaggctgatattactgttgccgccggcgctggcccacgtcatatggcgttccacccgaatcatcaggttgcttattgtgtcaacgaactcaatagctcggtggatgtgtatcaaatcagcaataacggtcaggaataccacttagtgcagagcctggacgcgatgcctgccgatttcaccgggacacgttgggcggcggatattcatatcacgcctaatggccgctatttatacatcagtgaccgtaccgccaacctgttgggtattttcaccgtttctaaagatggccgggtgatttcgttggtcgggcaccacctgaccgaagcccaaccacgtggtttcaatatcgaccacagtggtaatttcctgattgcttccggtcagaaatctgatcatatcgaagtttatcgtatcgatcagaacacgggggagctaaccaccctgaaacgttatccggtaggtaaggggccgatgtgggtcagtatccggggggcgcagaactcataaacaataggccattttactgactattttgaacctgggcagtgcggtcaccctgatgtacgcttgagtgactgtgcactgcccatgtctaaattgacggcgactgtggcgctgatgtcgcagagatctttacaccagacggcggaaaaaccgcgatgccgttaccttaaacggtgaagataggcatttagcttccgcgatctaccacggccgcagccacggccgcagtgagccgggttaaggcgtgttgagagataatataaggcggcatcagataaatcagtttgccaaagggcctgatccacaccccctgttcgacaaaactgcgttgcaggcgggcgacattaacgggttttttcatctctaccaccccgatggccccaagtacccgcacatcggccacggtatcttcctgagccagcggcagtaattccctttttaactgatcttctattttactcacctgctgttgccacgaattctctgctaataaactcaggttcgcagaggcgactgcgcaagccagcggattcgccataaaggttggcccatgcataaagcagcccgcatcccctttactgatggtttctgccactgcacgggtggtcagcgtggcggataaggtgagataacctccggtgagcgctttacctaaacataaaatatccggcacgatctgcgcatgttcacaggcaaacagtttgcctgttcggccaaacccagtggctatctcatcggcaatcaataaaatttgatgtttatcacataacgccctgacttcacgcagatagctggggtgataaattcgcatcccgcccgccccttgcaccacgggttccaggattacggcggcaatctcattggcgtgctgggttatcagcgcgacaaaattagcgatatcttgcggatcccacgggtcatcaaagccgcactgtggcgcattggcaaacagattctcggctaaatagccctgatacaaactgtgcattgaattctgtgggtcacagacggacatcgcaccgaacgtatcgccgtggtaaccatggcgcaaggtcaaaatacgctgccgctgctcgcccttcgcttgccagtattgcaacgccattttcagtgcgacctcaacgctcaccgagccggaatcggccaaaaaaacgcattccagcggcggcggtgtcatcgcgaccagttgtcggcacagctttactgcgggcggatgggtaatgcccccgaacatcacgtgcgacattttatccagttgctgatgcgcggcgaaattcagtaccgggtggttatagccatgaatggctgcccaccaagatgacataccatcgatcagccgccgaccatcagccaattgcaattcaacaccttcagcgcccaccacggggtaacagggcagtggctcagtcattgaggtgtagggatgccagatatgctgttgatcaaaaactaagtcagaaggtgtcattaggtaccgttgtaaaccaaaatatcaatagaatggttgacagtatatcgagtttatttacactgacgaaactttttctcttcttttgagaggccatcatggcaacttatcatcactggacagtagggcaagccctggccctgtttgataaaccgctgttggaattattgtttgaagcacaacaagttcaccgccagcattttgatccgcgtcaggtacaagtcagtacgttgttgtcgattaaaaccggtgcctgtccggaagattgtaaatattgcccgcaaagctcccgctataaaaccggtctggaaagcgaacgcttaatgcaggttgagcaggtactggaatctgccaagaaagccaaagccgcaggttcgacccgcttctgtatgggcgcggcgtggaaaaatccccacgagagggatatgccttatttggcgaaaatggttgaaggcgtcaaggctctggggatggaaacctgtatgacattgggttcgctgagtaaacagcaagctcatcggctggcggatgccgggctggattattacaaccacaatctggatacctctccagagttttacggcagcattattacgacccgcagctatcaggaacgtttggatacgttaaacgaggtgcgtgacgctgggatcaaagtgtgttctggtggcatcgtcgggctgggagaaacggtacgcgatcgtgccgggctgttggtacaactggcgaacttgcctaagccacctgaaagtgtgcccatcaatatgttggtaaaagtgaaaggcaccccgctggaaaataacgcagaggtggatgcctttgagtttatccgcaccattgcggtagcgcggatcatgatgccgtcttcctatgtccgtctgtctgccgggcgcgagcaaatgaacgaacaaacccaggccatgtgctttatggctggagccaactctattttctacggctgtaaattactgaccacaccgaatcctgatgaagataaagatctgcaattgttccgtaaattggggctaaacccgcagcagacggcaacatcacacggtgatcgtgaacaacaacaggccttgaccgagcagctactgcatggggataccgcccagttttataatgcggcggtctaatgagctggcaagataaaatagcgcaaggcttgcaacggcgacgtgatgcggcggcttaccgtactcgccaggtcaacgagggggctaatgggcgctggctacagtcaggcgagcggcaatatctcaacttctccagtaatgactatctagggctaagccaaaatgacgaggtcattgccgcatggcagcaaggtgcacggcgctatggggtggggagtggcggttcgggtcatgtgaccggttatagccaacctcatgcccggttggagcagcaattagctgattggttgggctacccgcgcgccctgctatttatctctggttatgccgcgaatcaggcagtgctgacggctctgaccgatgctgatgaccggatattggcggataaactcagccatgcctcactattggaagccgccgcgcattcacccgcgcagttgcggcgtttccagcataatcagcccgaagcgctgcaaaatctgctgatcaagccttgccagggccagacgctggtggtcaccgaaggcgtatttagtatggatggcgatagtgcgccattggcggcgctgcagcaacagacgtcagccgcgggcggctggttactggtggatgatgcgcacggtattggggttcatggtgaagaggggcggggcagttgctggttacaaggggttcaacccgagctgttagttgtcacgtttggcaaggcgttcggcttaagcggtgcggcggtcttgtgtcaggaaccggttgctgaatacttgttgcagtatgcccgccacctgatttacagcaccgccatgccccccgcgcaagcctgtgctctacaagccgccttgcgccaagtgcaacaaggtgatgcattacgccaacaacttcagcagcgtatccgccaatttcggaccgcggccgcgcatttaccgctgcaactgggggcgtcaaaaacggcgatccaaccgctgttggtgggcgataatcagcaaagcctgatctgggcagagcaactgcgtgctgccggtttatgggtgacggcaatccgcccccccacggtgccaccaggaagcgccagattgcgcattaccctcagcgcggctcaccaacccgaggatatcgatagattattggaggtgctttatggcctctgtcactgagcacgcgcaatggggcgttgggtgtttaccgccactgaacgttgataaacaggcgattgcggctgcattcagccgggccgccgagagctacgacagcgcggctaatttacagcgagaaacgggtcatcggttagtgcagttgggccagcagcatacgggttttgtggtgttggatgcgggttgtggcacggggcatttcagccagcattggcgcttgttgggtaagcgggtcattgccttggatctggcggcaggtatgttggattatgcgcgccaacagcaggtcgctgacgactatctgctgggggatattgaacatattccactgcctgatcagtcggtggatatctgctttagcaatttggcggtgcaatggtgttcagatctgggggcggcattgagtgaattctaccgagtgacgcgccccggcgggatcatcctattttctaccttggcagaaggctcccttggtgaattagggcaagcgtggcaacaggtggatggtcagcgtcatgtaaatgattttttgccattacaacatatccagacggcctgccaatattatcgccatcacctaacaaccgcgttatatcagccacggtttcctaacgtgatagcgctaatgcgctcgttacaaggcattggtgccacgcacttgcatcatgggcgtcaggctgggttacaggggcgtcaacgtctggcggcgctacaacgggcctatgtcatgcaatctggcggctatccactgagttatcatatggtttatggggttatctatcgtgactaaacgttggtttatcaccggtaccgatactgatgtcggtaaaaccgtcgccagttgtgcattactgcaagcggccaccgctcaggggtaccgtactgctggctataaaccggtagcatccggtagccagatgaccgctgacggcttgcgcaatagtgatgccctggcgttgcaggcgaatagcagccagaggctcggttactcacaagtgaatccgttcacttttttggaagcgacatcaccgcatattgccagtgaaagtgaagggagggcgatccctttgacggcgttatcacagggtttacgtcaactggaaccctccgctgactggatattgatagaaggggccggcggctggtttaccccgctttctccgcaggccacatttgccgattgggtacaacaggaacaattgccggtcattatggtggttggggtgaaactggggtgtatcaaccatgcgttgctcacggcacaggcgattcagcacgccgggctgacactggccggttgggttgccaatgaggtgacaccggcagggagacggcaggccgaatatcaggccacattgacccggatgataaccgcgccattgctgggaattattccctatctttctgatatagaagaaaatccggtgacaacacgccgtgatcttgggcactacttggatttgacggtattacgtgcagcagaacgggaggctgtcaacatgtgatacatatatggacgccgctacaagcatgtgatgtggcttgcaatcagaggccatcaggtgcgattaaccttatgtagttaatctacccgagtatagttaatctacccgagtatggttaatctacccgagtatggttaatctacccgagtatggttaatctacccgagtatggttaatctacccgaatatagttgatctacctgaatgcgccgcggccctgaggttgctcagcgggctaaatgctcgctaatcaagccttcattcaattgatctaacgtcccctgagcgacatttcggccacccgccatcaggcaaaagcgatcagcaatatgctgaataaacggcaagcggtgttcgaccaataatagggtcatacccaaattacggctcagttgatgcaaaaccgtactgatatcttcactcagcgctggcgaggtaccgctgcccggctcatcaaggataagcagttctggctctgcgaccaaggctctggcaatggctagctgttgttgttgattacgggtcagctcaccacctcgttggctacgtttatcgtgcagtaatggaaatagctcaaaaacccagcccggaatcgggtgggatttgtggcggcctgccagcacggcgaccagtagattatcctcgacgctcagttgggagaaaatttgctgaccctgtgggacataaccaatgcctaacgcattgcgtctttcaacaggctgctgttgcaagttttgcgggggttcatggtgaggctgccagatcatggtgccgcttttaatgggtagatgccccataatgcaattaatcaacgtggtttttcctacaccattgcggcctatcaggcacgtgcattggccgcgagggagctccagattgatatcccagagaatatgattatttccatagtattgatttacagcggttaaacttagcatcagtgcgtctccttagtcgatcccagtagttcacaggtaccccggtgttctgtaacggctagtgagagttaaccagcaaatctgcatacttggtcgcagtagtagagcataaaatgcgacactgattacgcggggttgcgcgtgtaaacagcgcttaaataaccccttagtggcattaaatgatgcaaaagcgctatttttaccactaataccttcaagagtaggccctatccagccaattggtttgctgaattgttttcagctgattcatctatccttcagataatctacagagatcaagcaactcttggaccaagttgccgaacacagaagtaaaatttgtatgttaatggcctgtaaatgttttttttggctaaggagaggaagaataataaagttcgaggcagggaaggggggccatttggggtggggtgcacctaaatagtgccctggtgctcgttctggtgcaaaaaggaaccgctctctgattttggataaggtgataatacgaataaatgctagttataacattagcaagcagtgtagttagcactaattgaaatatgcgttgaaataaaaacatcaaaaaaacactaaaaaaggccgtccatctccatttcatcgtgaagttttgtttttcgccagctcccagcctctgtggggttgattgagttatccactattcctgtggataaccttgtgcattaacaatacaaaactaaagagaggcgagagccagcgcggcttaggctcctgttgtccggattctctcctttttgttaaatgtatttaatttcaatgtgttaaataaaatcaagcgcctggtgttcattcgaaaaaatgatgagtaatgtttaatcaattatttggggatatcttgatcgcagtagcatttggggataaaaatttttacggtataaatgttaccaaattgtcactgtaaagggataaccgttgcatcgatacgaaaattcctgtcattgggtgtttgaagctggttttatatccagtatcataaggttggcaaaaatctcgggggctttcataattagccccctgacagtgtgtttctcccgcgggtagcgaattcatgagcaaatcattcaaactgcattctgtgtttaagccagctggcgatcagcctgaggctatccgtaaattggaggaggggctggaaaatggtctggcacaccagaccctgctaggcgtaacaggatcaggcaaaacctttacggttgctaatgttattgccgatctgaaccggccaaccatgatcctggccccgaacaaaacactggcagcgcaactttacggcgagatgaaagagttcttcccggataacgcggtagagtactttgtctcctactacgattattatcaacctgaagcttacgtgcccagttctgatacttttattgagaaggatgcgtcggtcaatgaacacatcgagcagatgcggctatccgccaccaaggccttgttagagcggcgagatgtggtggtcgtggcgtcggtttccgccatttatggtctgggcgatccagatctgtatctgaaaatgatgttgcacctaacccgtggcatgatcattgatcaacgttccattttacgtcgcctgtcagaattgcaatacagccgcaacgatcaggtatttcaacgcggtacttttcgggttcggggtgaagtgatcgatatcttcccggcagaatctgatgagtgggcgctgcgggtagaattatttgatgaggaagtcgagcgattatccattttcgatccactcacgggtcagctacagcatgaagtccctcgctttactgtttatcctaaaacacattacgtcaccccacgggaacgcattctacaggcgatggaagagataaaagtcgagctggcggagcggcgtcaggtgttgttagccaataacaaattattggaagagcaacgtctctcccaacgtactcagtttgatcttgaaatgatgaatgagctgggctattgctcgggtatcgaaaactattctcgctatctctctggccgtgggccgggtgaagcgcctcccacgttatttgactatttaccggctgatggtttgttgattgtcgatgagtcccacgtcactattccgcaaattggtggcatgtacaaaggcgaccgctcacgtaaagaaaccctggtagagtacggtttccgtttgccatcggcactggataaccggccaatgcgctttgaagagttcgaagcgttggcaccgcaaacgatctatgtttcggccacaccgggcaaatacgagctggagaaatctggcggtgacattattgagcaagtggtgcggccaacgggcctactcgatccgttgatcgaggtccgtccggtagccacacaagtggatgacttgctgtcagagatccgcatccgtgctgcgattaacgagcgggtactggtgaccacgctaacgaaacgaatggctgaggacttaaccgactatctcagcgagcatggcgccaaagtacgttacctgcattcagatatcgatactgtggagcgggtggagattattcgcgatttacgcttgggtgaatttgatgtgctggtgggcatcaacttgctgcgggaagggttggatatgccagaggtctcattggttgccattcttgatgcagataaagagggcttcttgcgttctgaacgctccttgattcagactattggtcgtgctgcccgtaacctcaacggcaaggcgattttatacggcgatagaattaccgcctcgatggaaaaagccattggcgaaacggaacggcggcgcgctaaacagcaggcgtataatgaagaacgcgggattattcctcaggggctaaacaaaaagattggcgatatcctgcaattgggccagccttcaatgcgtggcaaaggaaaagggcgcggcagtcataaaatggccgataccacccaatatcaatctttgtcgccgaaagcacttgatcagaaaatccgtgaactggaagcaaaaatgtatacatatgcgcaaaacctggagtttgaacaggcggctgaattacgtgatcaggttcatcaactgcggcaacagtttattgcaatatcttaatttttattgtgacatcttaagtttattgcgacatcttaagtttatctcgctgctttaaggtttgcttcagcgccttaaggtttatcgagatgccttaaaacttatttcaataccttaaggccgaggggcagaccgttggccactggcgtacatcccacgtgaaatatgacgagtgtatccagaaatacttgtcgcactcatcgattctcagtaaggtgtgccgctaaaattatgacgatacagataattatctgtcagtgtactgttgtcaggccatgagatatttatctcataacacaagagaaaaacgatgagcgagcatttatctaaagatccgctgcacgggattaccctagagcaattgttgacaaaattagttgaaaactatggctgggatgggcttgctgatcgtattcagattaactgttttatcagtgaccccagcattaaatccagcttaaagtttttgcgccgtaccccgtgggccaggcaaaaagtggaagcgctctatattgagatgagcgacaaagcggagtggttgaaaggccagtcttgagccgcctgcctcgcgggttattacgtgtattccatctattttatggattttatttacgccatttgctctctctgcgagcgagcggcgctgcgggtgatgagcggcaaacgtattgtggggcatcggcaacttacaccgagtctgcaccgttcaactgttgcaaggtgttttccaacgcctgacgcaataactcgcggtcatggcggtgaggaatatcttttgcttccagtggttgttggacaataattcggtcttttacgccactgatatcgattgttgggctgacaataacggcatcaatgattttacggccaatcttgctttccatgatggtcagtttgtcttgtaatgacagcgcagcggcggcggggcttaattcgcggcccagattcccaatgtaaatcatactggcagagctgcggcgcaatgcctgagttaactcatccagcagcagtaatggcattagactggttagaaaactgccggggccaatcaaaataacatccgcctgattaatggcttcgacggcttctcgggtggcgtgtacagggggcgatagcaacatttcttgtggcatctgcgccaattgatcgatattcacttcaccataaatagggtgcccttcatggtcaatagccatcaaatctaccggttgttcggacattgggatcaacaaggcatccacttttagcaagctacgcaccaaattgatcgcttcaatggggcgaatgctcaggtgatctaatgctttcagcatcaagttacccaaattatgccctgccagctcaccattaccggtaaaacggtattcgaacatcgcggaggcgacacttggctcggtaatcaactgattaaggcaattgcgagtatctccccaggcaattcccccctctgagcggcgtatccgcccagttgaaccgccattatcggtggtggtaacaatgcctgtcaggcgagagcctaaggaggagagagacgacattacccgccccaaaccatggcctccgcccagagcaacgacccgttccaaatccgctaatgtgcgatttcgcatatttctcctgttgttatattcggtgcctggcgattatcgcgcatactgtttttatcttgtgttgcaacgctaatgaacctggctgccatgctaatggcgttggggaccgttaatcataaaattgccgcataagttaacggatttgtgattgaaacgcgatataagccatgatttttgtgattttaaacaaggcatcaatcccggattcagtaagctgaataacaataacgttgaatagataagtcgttgtatataataatatatagcgagaaactatcattggctatcctgccattttaacgttagaatctttaggaaaagtagggtttttaatggttagttgttgtttattgccttactttttaacgccatgatttagcagtaaaatataagttacagctgaacataaactcctagccttagcgtctacgttgtcttttttgtattggcaatatgatgttctggccgtggccttaagccaccagggtgcaaggtagaaatgcctgcatctcccgtatttggaaaggtgttatggtacaactcactgacgcatttgcgcgtaaattctactatttgcgcctatcgatcactgatgtgtgcaatttccgttgcacatattgcttgccagagggctaccgcccagatggtgtcaaaagttttttgagccttgacgaaatcaatcgcgtcagccgcgcctttgccttgttgggaacggaaaaaatccgcctgacggggggcgagccttcgatgcggcgcgacttcactgatattattgccactatccggcaaaatcccgctatccgtaccttggccgttacaactaatggttatcgtttagttcgtgatgtggcgcaatggcgtgatgcgggcctgacggcaattaatgtcagcgtcgatagcctggatccgcgacaatttcatgccatcaccgggcaggataaattttatcaagttatgcagggcattgatgccgcatttgatgccggttttgacaaagtcaaagtcaacgctgttttgatgcgcgatgttaatgatcgccaactgagtgcattccttgactggatcaaacctcggcccattcaactgcgttttatcgagctgatggaaaccggcgaaggcggtaacctgttccgtaaacaccacgtttctggtggcgtcatccgccaacaattactcgaacaaggctggcagcagcaagatcgggcgcgcagtgatggcccggctcaggtgtttcaccactcggattaccaaggtgaaattgggcttatcatgccgtatgaaaaagacttttgcgccagttgtaaccgcctgcgtgtttctgctctcggtaatttgcatttgtgcttatttggtgagcaggggattacattacgtgatctgctgggcagtgatgatcaacaagatgagctgatagcgcggattcaaagtgcgttgcaaacgaagaaacagactcattttttgcatcagggtaacagcggtataacgcaaaatttatcctttattggcggctgatgtgagcgaattagcgccgatgagcttacatcagtaagtgattcgggcaagtgaatgccgctaacccccctgtaatgtcaagcgaagggaaatgcccaaagttattggcattacaggtaggcagcaaatgagtgagcgccgatgagcttacatcagtaagtgattcgggcaagtgaatgccgctaacacccctgtaatgtcaagaacgaagggattttattgatgacccaactgacacacataaacaccgcaggcgaagcccacatggtcgatgtctcggcaaagaatgaaacggtccgcgaagcacgcgcagaagcgtttgttgacatgcaggccgcaacactggcaatgattatcgatggcagccatcacaaaggggatgtgttcgcgacggctcggatagccggtattcaggcagccaaaaaaacgtgggaattgatcccgctgtgccatccgttgctgctgactaaagtggaagtaaaactggaagcacagccagagcataaccgggtgcggatcgaaacctgctgccgcctgaccggtaaaaccggggtagaaatggaagcccttactgcggcttcagtcgcagccctgacgatttacgatatgtgcaaagcggtacaaaaagacatggtcatcggcccggtacgcctactgacaaagagtggcgggaaatcgggtgatttcaaggtggatatatgattcagattctattttttgctcaggtacgtgaactggttggggtggataaattacagctagcggccgagtttccaactgttgaagcgctacgtcaatccctgtgtcaacggggtgagcgctggcagttggcccttgaagagggcaaattactgacggcggttaaccaatcattagtgagtgctcagcatccactggccgcaggtgatgaagtggcgtttttcccgccggtgaccggggggtgatgatggaaaatacgcgtatccgtgtcggcgcagaagcgttcagtgtgggtgatgaatacacatggctgtcgcagtgcgatgaagacggcgcggtggtgacattcactggcaaagtccgtaatcataatctgggggccagtgtcagtgcgctaacactggaacactaccccggtatgacagaaaaagcgctgacggagattattgccgacgcacgcagccgttggtcattgcagcgggtatcggtcatccatcgggtcgggccactattccccggagatgaaattgtctttgtgggtgtgaccagcgctcatcgcagtatggcatttgaagcagcagaatttattatggactacctgaaaacacgggcaccattctggaagcgggaagccacggtcgagggtgagcgctgggttgaatcacgggacagcgaccatattgcggctaaacgctggtaatctaggcgcagaacagtataaaaatcacggctaaatgtctatttttactcctttgtttccgctatttctatggtacccttaaaaagacggtgggctgtcagtcgatagcctgtatttattatttaatacaaaggtaactaccatggatcgctatccacgctctaatggttcgattgtcgaacgtgccggctcaggcattcaggcctatatggcgcaggtatacggttggatgacctgtggcttgttattaaccgcagttgtcgcttggtatgccgcgaacactccttcaatcatttttgctttgcaatcaaaccaaatattgttctttggcttgattattgcccagcttggtctggtttttgttatttccggtatggttaaccgcctgagtggaaccgcagcaacatcactgtttatgctgtattccgcgctgaccggcctcaccctttccagcatattgataatgtacacgggcgcgtctatcgccagtactttcgttatttgtgccgggatgtttggcgccatgagcttctatggttacaccaccaaacgtgatctgagcggtatgggcagcatgttgtttatgggcctgatcggtatcattctggcatctcttgttaacatctggctgaaaagcccagcgttgatgtgggctgtgacctatatcggtgtgctcgtgtttgtgggcctgactgcctacgacacacagaaactgaaaaacttgggcgcacagttggatgtcaatgataaagattcattccgcaaatactccattgtgggcgcactgactctgtatctcgatttcattaacctgttcttgatgttattacgaatcttcggtaatcgtcgctaagcgggttgattaaacgctatggcgcggtaagtttgcccaccgacatggtttgagatagtaaaggacaccaaaatctggtgtcctttttgtttttctttcaccagtggtcatcaccgtttctatgtagaagttgccgtttgatgcgctgagcaacggtttgtatcgatgatcaatgtggttaacgatcctctacgtatttcgtgattttctttacggatatgatgttacgggtaatgaatgccttacgggagatgtacgggcaggagtatctccggcgataaaatacgcggcgttgctttttgccagtggttggcagccacgaatacgatccgctattttctctgcaatcatgatggtcgtggcattgaggttgccggtaatgatttgcggcatgatagatgcatcgaccacccgtagcccttgcacaccgtgcacccggccttgcccatcaaccaccgccatcttgtcgtcacccattttacatgagcacgaaggatgatatgccgtctcggcatgttcgcggatgaaggcatccagttcgtcatcgctttgaacattggccccagggcttatctctcgaccacgatatggatccagtgcaggctgcgcgataatctcgcgggtgatgcggatagcatcacggaactcatgccaatcctgttcgttcgacatgtagttgaacaagatactcggatgctggcgcggatctttcgattttacctgaatgcggccacggcttggtgaacgcatcgagccaacatgcgcctgaaaaccatgctcttttacagcgttgctcccattgtaattaatggcgacgggcaggaagtggtactgaatattcggccaggtaaatgcatcgcgactgcggataaacccaccggcttcgaattgattgctggcacccacgcccgtaccgttgaataaccattcgataccgattttgggctgattaaaccacagcagagcagggtaaagtgacaccggctgtttacagctatattgcagatacatctcaaggtgatcttgcaaattctccccgacgccgggcaacgcctgcaccaacggaatatccaggcgttgcagtaattccgcagggccaatacccgagcgctgtaaaatttgtggtgacgcgatagcacccccacacaataaaacttcacggcgagcatgggcggtttggccggtgccagcatcacctttgaggtagctgacgccagtggctcgtttcccttcaaataggatccggtccgtcagggcgtgcgtaataatggttaggttattgcgtgggcgcgcctgatcaagatagccgcgcgcagtactggcacgacgacccttcggcgtcacagtacgatccatcgggccaaaaccctcctgctgatagccattcaggtcatcagtacgcggataaccggcctgcacacccgcagcgaccatcgcatgaaataacgggttgttgtcgattttaggtgtggtcacgctgacagggccttcaccaccgtggaaatcatttgggccgacgtcgcgtgtttctgccttacgaaagtacggcaggcaatcaagataactccagtcctccagacccgataaactggcccagtggtcaaaatccatggcgttgccgcggatgtaacacatgccattaattaatgatgaaccgcccaaacctttaccgcgtccgcactccatgcggcggttgttcatatgcggctccggatcggtttcataagcccaattataacgtttaccctgaagtggaaaggcgagcgccgcaggcatttgtgtccgaaaatccagccgatagtctggtccacccgcttcgagcaagagtacggtgacatccgcatcttctgttaaacgggctgccagcacgttgcctgcagaaccggcaccaatgatgatgtaatcgtattccattggatgtccctctggtgttggattaaaaaacagaattgaagctgcttaactcaacctgaattgatttgatttgcgtgtaatgttccagcgtgctgataccgttttcacggcctacaccagaatgcttatatccgcctacaggcatctctggtgccgattcgccccaagtattgatccagcagatacccgcttgcagttgatgaatcacgcgatgggcacggttcaaatcctgtgtaacgacccccgccgctaaaccgtactcggtatcattggcgcggcgaatgacttcctcttcgctttgataactcagaatgctcatcaccggtccgaagatctcttcacgcacaatttgcatgtcatcacggcagtgggtgaataccgtaggggcgacataggccccgtgtgccagtgcgccctcggtcagactgtatcccccgatcagcagggttgcgccttcccgtttaccgctgtcaatgtaacgcatcactgaatcgcggtgctggaagctaaccaacgggccaaagttggttcgttcatcgcttgggtcaccaatatgaatccgcttgacccgttcaacgattttctgctcaaacgcggcctgtaacgccagcgggacaaaaactcgcgtgccgttggtgcagacttgtcctgagctgtagaaattggccatcatcgcaatatcagcggccttatcgagatcggcatcagcaaaaataattagtggggactttccgcccaactccatggtgacatctttcagggtcgatcccgcggcgttagccatcacctttttaccgctggcaatccccccggtgaaggagacctttgcaatacccggatgctctgtcagcatctgcccaacctggtcaccactgccggtcaatacgttaaatacgccagccggtaaacccgcttcggtgtagattcccgccaatttcagtgcggtcagcgatgtcacttcacttggtttgaagatcatagcgttgcccgccgccagcgccggtgcagatttccacaaagcgatctgaaggggatagttccaggcaccaataccggcaaccacgcccagtggctcacggcgggtatagacaaatgcgctgccacgtagtgggatctgttgcccttcaagggcggggattaggccagcataatattccagcacatcggcaccggtaacgatgtccacagatcgggtttcggataggggtttaccggtgtctgccgtttcaattgccgccagttcatcattacgatcacgcaagatatccacggcccggcgcaagatgcgtgaacgttccatcgcggtcatcgctgcccacacaggctgaccttgtttggcggcggctaccgccttatcaacatcctgtgcgttggcggcctggagttgtgcaatgcattcgccattcgcggggttcacggcatcgaaagtatcaccactggtgctgtcggtgtacgcgccgttgatataaagtttttgcaagccgtagcgggacatagtctctcctgtcttttcctgtacggctaaataccgttcagtgcgttcgaattttgttcagcacttatatttaatgttcaattgctgctcaatatagttatggataatcagcagcgcttcctgacggttaaagtgttcgccactcaatgcactgcgtagccataatccatcaatcaaacccgccatacctttagcggcgagctgcgcttgctctcgcggtaaacaacgtttgaattcagcacataaatttgaatagagtcggcggttattcacctgctgtaaccgatacaattgtgggctatgcatactgcttgcccaaaatgccagccaggttttcatcgcggcgctattgatctggctgtcatcaaagttgccttcggcgatcgcccgcaaacgggcacgaggatcgttgacggacagggcagccaagtgctgcttcaccgcctcgccaaggtgccttatcagatacctcattgtggcttctagcaggccatttttgtcacggaaatagtggctgataatgccgttggatacgccagcacgctttgcaatctgcgcaatagacgcttcatgcattcccacttcattcaccgcggccattgttgcctcgatcaattgctgccgtcggatcggctgcattcctacttttggcacgggtctggactcctttaaattcaatcaattaatactgttattcatgctgcctattggcagccagttacccgttacgaaacactattaaacttttttttgattgaacgttcaataaaaaatgaatatattttattgctgataagttaaatttttgtgtgaacattgattgtaacttgttgatgttagaagttaatcacgttggtatcggataggtggtttttagctcaccaataacgtcagctcaccaaaaattggcggtaagtgcactcagcggatcgcctgcgagcagtctcttgatatgcgctaaggggcgcttacctgccaaatgcgatgagcctcactttttttaaaatgcaggggaaacgatggtgacttcagacatcgacacaaaaccgcaaaaggatacgttaaatccggtggtgttctttacgtccgcagggttgatcctcgcgttctgtcttatgactattttttatactgacctctctaatcgctggattggtattacccttaactgggtctctgccacttttggttggtactatctgctggcggccacgctgtatatcgtttttgttatttatattgccacttcacgctatggctcaatcaaacttggccccgagcagtcaaagcccgagttcagcctggtcagttgggcggcaatgctgttcgccgccggtatcggtattgacctgatgttcttctcggtagccgaacccgtgacgcaatatatgatgccaccagaaggccagggccagactctggaagccgcgcggcaggcgatggtctggacgctgttccactatgggctgacaggttggtcaatgtatgcattgatggggattgcactcggttacttcagctatcgctataacctgccgttgaccatccgttccgcgctttaccctatctttggtaagcggatcgacgggccaatcggccacagtgtggatatcgccgccgttatcgggacgattttcgggattgccaccacattggggattggggtggtgcagctcaattacggcctcaatgtcctgtttcatatcccggaaagtctggcggttcaggccgggttaattctgttgtcggtggtgatggcggcagtatcggtgacatcgggtgtcaacaaaggcattcggatcctctctgaagtgaatgttctgctggcgttaggcctgatcctattcctgctgttctgggggaacacggaattcctgctgaatgcgctggtgcttaacgtgggggattatatcaatcgctttttgggcatgacgctcaacagttttgcttttgatcgcccaacccaatggatgaatagctggacgctgtttttctgggcatggtgggttgcctggtcaccctttgttggtctgtttctggcgcgtatttcccgtggccgcactatccgccaatttgtggtcggtacgttgatcataccctttgtcttcaccttgctttggctgtctatcttcggtaatagcgcgttgtaccagatcctgcatggcaatattgcttttgctaatgaagtgatggagtttccggaacgcggtttctatagcctgttagcacagtaccccggtttcactttgagtgcttcggttgccacgatcaccggcttgctattttatgtcacgtcagcggattccggttcgctagtgctggggaatttcacctctcgtctggccgatattaataatgattcccccaactggttacgtactttctggtctattactatcgggttactgactttgggaatgttgatgaccgatggtgtcaccgccttgcaaaacgcaaccgtcattatggggttaccgttcagttttgtgattttcttcgtgatggtcggcttgtataaatcgctaaaaattgaggattaccgcaaagccagctcgcaacagacaccaacgcctacgctgatttcaggcaatgaagtactaaattggaaacaacgtttatcgcgagtaatgaactacccaggtaccacttataccgcgaaaatactggataccatttgccgcccagcgatggaggaagttgcgcaggaactggccgtacgcggtgttaaagttgaattcaacgaactgccgccgaaggaagatgaacaactgaatcgtcttaatcatctggagttgctggtacatctgggtgatgagcagaacttcgtctaccagatctggccgcaacgttattctgtgccggcattcacctaccgtgcacgctcagggaaatcacactattaccgccttgaaacttatctgcttgaaggaacgcaggggaatgatttgatggactacagcaaagaacagattatcaataacattcttgaccagtatgagcgccatatgaacttcctacatattcaaagtgaagcgccgggaaatatcatgacatttcccgatcaatagtccgcaatagtccgcaatagtgggtctcttcatctggcgagtcgatgaagagatcaccaccgcttaatcaaaatcatctgccgctttttctggcttaactttattaatgtaatcgtctactatcaccgcctgacttaggtaataaatacatataattaagattgcggtttgattatcagacaagattattattgaaataataattcaggttgctcgcattaaaataattggataggtgatatgcaaaagcttcttttttccggtcgtatcaatttgaaaatgatccgctattttttagccgtttcagacgagttacacttcggaaaagccgccgaacgccttcatatctctcagccgccgttgagcctgcaaattaaagaattagaagatgcattaggtttccctctctttatacgagacagccgtaacgtggtgttaaccctggcgggcgaaatgatgaaggctgaaatgaaagatgtatttgataatatagagaattcattaagccgcgtatcctatattgcccgccatgaacaaacccaccttaatattggcattatcggttccgccctttggcatcagctactagagaaattcaagcattataagacagtcaatcctaagaccacctggtcgttacacgagctgccacccagtaagcagtatgaagccttattaaataagaagcttgatattgggttctggcgatgtgccgatctggaacagaatccggcgctgatctataggcgggtagaaaagcagcgtgtcgccgtcgccgtgtctaatgagagcttattggtgaataaaaaaatactcacgctgaaagatctctcagggcaaacgctcatatttctcacctttaatcactctggctactctaaaaatttatacaatagttgtcttaatgctggctgcacgccgcaggctatttatcagtttgatgaacctcagacccagttggcttttgtgaatagcaaccttggtatcgccttagttcctgaaagtatgcaggaaatcccatggcctaatattaaatttattccgctgaaagaagatctttctgccgatctcttcgctgtttatcaccctgatagcgtgactccggcactaaataagttgcttgcgttattttgagtgtgatttttgaatctgtggcattcactggccggtattacttggctttaactaaaatagccatcgcgataatcactaaaatggctccgctggcgatctcttgccaatttattgtctggcctaacatcatattagtgacaatgactgacagcgggatcaggtacacatagcctgatactttcgtcggcgaaagcacaatgcaggctttttggaacagaaagaaacttaatgcggtggcaaaggtggcaagatataaaacgccgctccaggtgatgacgctaatattgcgccattcaatttctggaagctgataggcgatgatcaccgttagcagtagtgtggcgcatatcaagctccaaccggtaagcaccaaggcgtgctcaccccgatgtaacttcttcaccacaataggattcagcgccatgcctaaacaaccaaacaggaacaggtaatcagatggcatcagcgacaagtgtaaaacctgagacaagtcacctttaaaaatgattaataatgcccctaaaattccaagcaataatgcggctaccacaggccacgtcgattttgagttcaaaaacaccacactcattaccatgctcattaatggcacagtggtgtataacgcactcgaatttatcgtgctggttgtctgcagtgaaaagatcatacaggcaaaatagagcagcggcggtaggctaatcagagtataacggcccaaatctcggtaatgaggtaacgttagtaaaccctgactcaccagcaatacaacaaaaaacaggcttgcaatagcgtatctcagccaggtaattaccattggtggcagtgcgttgctgatggtggcgctggcaataaaggaaccgccaagtagagcggtaaaccccaacatttgcaaatgcgctttaagtactcttgttgtcatgtgcttacccattaccctcttgtgatcgatgataattgcgtggaaacacattctgaaccattacattttcagtatggattagcgggtttttagtattggttatgcaataacccactacttatgatggggtagattagatctatctctacctttcgtctttgacgttgcggcggtgttagcagcatttagtctcccctatcactcagggagttagctcatcactttgcgctcaggtgtagtaacgccaattactcgaggtacatatttagccggtttatttgagcgttattaaaataatcaaggggttttattatgacaacagtaaattcaaatataaacgttgatgctgatttcaatgaattaccatttcaagccgttaaatatattcagaaaataaaacccggatttaagcctcaaatcgcgtttattttaggttctggattgggtgatttagttgatcaaattacgaatgacaccacaattagctacgctgatatccctggcttccctgtaagctcggttcacggtcatgctggcgaactggtgctgggcgatctgtgtggtgttcctgtgatgtgcatgaaaggccgtggccacttttacgaaggcaaaggcatgagcatcatgaccaatccggtgcgcacatttaaattgatgggctgcgaattcttattctgtactaatgccgccggttcattgcgcccagaagttttgccaggttcggtggtgatgctaaaagatcacattaataccatgccgggcacgccgttagttggccctaatgatgatcgctttggtccacgtttctttagcctggcgaatgcctatgataaagatctgcgtgctgatatggctaaaattgctcaacagcttgatatcccgctgaccgaaggtgtatttgtctcttacccagggccttgctttgaaacaccggctgagattcgcatgatgcagatcatcggcggtgatgttgtgggtatgtctgtcgtgccggaagttctctccgcagcccattgtggtttaaaagttattgctctgaccgcgattactaacctggctgaaggcctttctgatgtcgttctgtcccatgaacaaaccttaaaatttgctaaagtggcatccgtcaatttcactaaattgattgaagcattcttaaaaagcaaagcgctccgttaatcgataaagacgtcataaatattttatgccccctattatgccagccgcaaataggggcaccgtaaatgagggatataccctataggctcaatgcgaaaaaatatattcctcgacgcatttgaatcacggagaataaaaatgataataaaaaaacggcttaaagttatgtttttccttcagttctttatctggggtgcctggttggtgacgctgggcgcttacatgatgaatacgctgaactttaccggtgcacaggtgggtttagtctatggcgctaaaggcatcgcctgtattttaatgccgagtctggtcggtattattgccgatcgatgggtgaaagctaatattctctatgcgtgttgccacctgctgggggcggttgcgctgttgatcgccgccaatgtttcagaccctaatatcatgttctttgtgatgttgttcaatgcgatggtctatatgccgacgattgcactggctaataccatttcttatatctgtttagaaaaagcggggctggacacgattaaagatttccccccggtacgcgtctttggcaccattggttttatttttgccatgtgggctatcagcctctccggatttgaattgagtaatatccagctttatatcgcttctggtgctgcgctggtgttggcgatatatgctctttcattaccaagctgtccaacatctaatattaaaaaagaccgctcgtgggttaatattttagggcttgatgctttcgtattatttaaacaaaagaaaatggctattttcttcctgtttgccatgttacttggcgcttcattacaaattagccacacgttcagcagccccttcctccatgactttgcaaaaaatccaatttatcaggatagtctggttgtccaatacccctcgatcttattatcgatggcccaaattgcagaagtcttctttattctggccattcccttcttcttatctcgctttggtatcaaacgcgtgatgatgatcagcatgattgcctggacgctgcgcttcactctatttgcctatggcgatccgtcggctaccggtattgttttattactgttatcaatggtggtctatggttgcgcctttgatttctttaatatctccggtgcaatttatgttgagaaagaggtcgatcataatatcagagccagtgcgcagggcctgtttatgacaatggttaacggcgtgggggcttatgtgggtgccatcaccagtgggcatgtggttgattatttcactgttaatggcgtcaaggactggaatagtatttggctatcttttgctgcttacaccgttattctggtcattgttttcttcttcgtttttcaagataaacatgagccaactgatctaaaaaaccgccagttatcccattaatcattatcgggaggaagtctactcgtccaaaatagactctccagataacccctgattaatcaaatgttaatcaggggagtttctattttatcggcaacctctcccaccggccattcccatatgattaccccctcttgaaccatggtttcccgtcattgctatccccgcttttgctaactgggtatccattgagacgcgacgttggtagaggctatctcttaacgtttgaatctctttactgacagccagaaccttttgttcatctactggtttgctggttaatagcgctttgtactcatagtttttggaggtcagttgttggcgcatatctgctgttgatgcctgaaattcattaagtacttgctggcgtatcgcctgttgttctgtcgtcaaattcgccatggaattctttccagagtactttccctgagaatgagacatatccgtgccgtcgccattcatatgggtgcccatagcattttgagcaatagcagagccaccgaatccaatcagggtagcaagagaaagaagggttacaatcgctgttttgttcaggttcatagtgagtatcctttatttcggtatgagtcagtgaaacgtcacgtagtaagcttattacgttaaagcaattcctatgccaatatgctaatggcatgataattgctttaaataatggttgtttttctagttagtgtgattatataaaataaggaatatcaattgattaggtttattattggccattttattatcggcgggcagttattcagacacggtctatagcaggagtgagaggtgatacattcagtaaaaacgggtaattattacccacagtagcggcgatgtgggtaataattacccgccaccaattcattgatactaaccaataataaaaataaggatgagaagggtgaaggaatctaaaggaaaatcgaatttattctctgtgatcccatacggtttttttgttggtttagtgatcattttgatcgccgtgattatcactatggcgattaaggacctgaatcgtgggcgcaacattgaatttcagacactattagaaaaaagcgccgtattgattcgttcctttgaatccagctcgcgtacaggcatgggaatgagttggcgtcagcgtcaaacattgatggaagagatggcttaccagcctggcgttatctatattgcggttaccgacctatcagggaaaatccttgcccacagtaacccggcacgtgtcggaacgcagctctatagcccacaagagatggcggatttaaacgttcagttagctgaacagtggcggatagcggcttttcttgatgaggataataaaagtcaggatgcttttgaggtctatcgtttctttaagccactgagacgcaataatacccatcagtcccatatgaatatggtgagaaggagtaacgttgctgcgactcaagataataatgacaaatatgaaaatcaaagtgtcatttttaccgccttcgacactgaagcgttagatgcgatgcaagcaaaagatattcgcaatacgattatctttttgtctattctcagtatgttggctctggcgggtattctggccctattctgggcgcgccgttaccagctttcccgacaccagctacaagactctaaagcgatttcaaccgaaattatcaataatctgcctattgggttgattaccaccaatgaagagcaattgatcagtgtcgtaaaccacacagcagaaaagatattcggtatcagtaaagatattctgaccggccaaaatattcaccaagccctacctccagaatggaatcttttagttaaaaaaagtcaacgccatcagccagtaatagagcatgaatttgattataaattaaaagaaggcctaattattccattgagcattagcgtggcaaatattgttaatcacaatggcagtttcctgggcaatatattcatctttcgggacatgagggaggttcggcagttacaagaagagatacggcgcaaagaaaaactggcggccattggcaatttagccgcaggtgtcgcgcatgaaataagaaatccgctctcttctatcaaaggttttgcgaaatattttgaggggcattccccgcaaggcagtgaggagcaagaattagcgaaagtgatgataaaagaggtcgataggcttaatagagcggtcactgagttactggggttagttcgcccatcggatttaaggatccaactcgtcaatattaacgagatcattgctcattcacttcatcttattcgtcaggatgccgatagcaaaaaaatcacaattcaatttatcagcaatgaaaacttgccacgagtggaaatagatcccgatcgtttcactcaagcattactcaacctttacttaaatgctattcaggccatggggagagcggggacacttgaaattgccctggcgcttgtcgaagagtcaaaattacgaattagcgtaatcgatacgggtaaaggcattagagcagaagatctggaaaacatctttaatccttatttcacgacgaaagcttctggcactggtttgggccttgctatcgtgcaaaaagtgattgaagagcatcaaggtagaatcaccgttaccagccacccgcaatctggaacccgctttgacatgacaatccccttggtacaacgcggccaatatcgcccagatgggcaagaacaaaaggcgtcgaataatgacaacacataaagcgcatattttggtcgttgatgatgacctgagccactgcacaattatccaggctttaatgaaaggctggggttatcaaaccacgccagcccacaatggattagaggccatcgaactggctaaagagatccctttcgatttaattctgactgatgtgcgaatgtctgaaatggatggtattgaggcattaaaggcaattaaagcctataacccggcaattcctattttaattatgacggcttattccaacgttgaatctgcggttgaggcaattaaagccggggcatacgattatcttaccaaaccgcttgatttcgacatgttacaactcacccttgagcgggcactggaacatacgcatctcaagaatgagaataaaacacttaaacagcagctcatcagtaaccaaaatattattggtcgcagcccacaaatgcgctatctgatggatatggttggcatgattgcgccttctgaagcgacggtgttgatatgtggagaatcgggtacgggcaaagaaattattgcccgctcagttcatgctaacagcccccgtaaagatcaaccgttggtgattgttaactgcgcggcactcagtgagtcattgctggagtccgagctattcggccatgaaaaaggggcgtttactggcgcagataaacgtcgggaagggcgctttatggaggcacataaggcaacgttatttttggatgagattggtgaaatctcagggttgatgcaggcaaaactcctgcgtgctatccaagaacgggagatccagcgcgttggcagtaatcagacattagctattgatgtcaggttgattgccgccactaaccgcaatcttaaagccgatgttgatagtggaaagtttcgccaggatctctactatcgattaaatgtggtcacgatagataccccggcgttgagagagcgaagcgaagatattccgccgttgtcgatgcatttcttggaaaagtttgcgctcaagaaccgtaaatcaatcaaaggattcaccccgcaagcgatgaatatgctgttgaaatacaactggcctggtaacgtgcgtgaattggaaaatacggtggagcgtgcggtgattttactgaccggtgatttcatcagcgagaaggagttgccgttaaatattaatcattatattcaggagaatgccggtagtgagaatataggttatgaggatgcagaaaaacctatccagtctctcgaatgggtcgaaatagacgctattttgactgcgttggaaaagacgggaggcaataaaacagaggcagcaaaacatttaggcatcacgcgcaaaacattgcaggcaaaattacaaaaaagaaattagctatttttttataaaaatacaggcattttaaaaagcggattgtgtttaaaataaaagtttaaatatcaatgtgttgtgtatttacctgcttaatctgacacccagggttcaatcagatctgacagtcagccctgtgccaagcggatgttataaagactatggtgagttaataagggtattctgggccacattttactcacctaacttcagtcatagaatgaactcgtcaaatataaatgcagcctgcgctttaaagtagaatttatggaacctcagttcggaacagatagctgttcacttatggccccgcagtaatcatcatgtttcttttattaatggagagataaatggacaagctatttacaccatttaaagtcggtgatactgaattggttaaccgcgtagtgatggctcctatgacacgctcacgagcaacggtgggtgatactgcagatgaactgacggcaaagtactaccagcagcgcgcatcggctgggcttattattaccgaaggctcacagatttccgtgcaggggcagggttatctctttacgcccggcatctataacgatgcacaggttaaagggtgggaaagggttacgaacgcggtccacaacgcgggtggaaaaatctacattcagctctggcatgttggccgtatttctcacactggtttgcagaatgacgggcaggcaccggtcagttcagtggcagtaaaagccaagaattcaacctgctatgcacgtgatgagaatggtcagcctggccttgttccggtgtctgaaccgcgtgcactgtcagtgtcagagattaaggatgtcgttcaggattacgtccaagccgcagagaatgctattcgtgcgggttttgatggcgttgagatccacgcggctaatggttacctccttgagcagttcatcaatggcgggctgaatacccgacaagatgaatacggtggtgcagatcctgaaaatcgtcttcgctttgtgttggaagttactgatgccatctcacaggcgattggtgcaggaaaaacggggattcgcctggcaccattcggacgccttttcgatatgcatccctttgagggcgaggaagaaacctggctactgctggcaaaagaactcagcacacgttcgctctcctatgttcacttgagtgaccagcaaacacttggcgaacaggctattcctgccggatttattgagaaatttcgcgctgcgtatgacggccctttgattattgccggaggttttgacaaacaacgcgccgaacaatatctccagcaaggaaaagccgatttgataggatttgggcgtccttatattgcgaacccggatctggtcgaacgtatggtcaatgactggccattaaatcaggttgatcgggcaacaatgtatggcggggatgaaaaagggtatacagactatccggtctggtccgatacccaggcataatcagtcgaggaggccgtcttctgctgccttaaccagcgtgtccacaacgtagcgtattttaggcagcagttgacggtttttcggccacagcgcactgatcggcatttcacctccggaatgccccggaagaacttcccgcagttcaccactctcaaggtatttaccaaccagccacaagggtaactgtgacaacccgccccctgccagcgtggcagcaagcatagcgtcaccatcaccaaattcatgtgtaggaggtggcgcaaagcgactgatttggccgtcactctccttcagcaaccaggaaataggctgactgcggcgaaatccgacaacgcactgatgctggctcagttcatccgtactgacaggctcgccgtgataaagcagataatccggtgaagcgcagataaccagtttttgcgtcgtgagccttctggcgaccagaccgctgctgtccgccagttccccaatgcgaatgacaaggtcaatgccttcctcaataaggtcgacaaaacgctcactgaatgtgacggtcagagccagctctgggtaaagtcggataatgtccagcaggataggaagtatacgctgtcgcccaaaagcggccggtaaatcaaccctgagccgccctgaaggctggcagatatgagacatcagttccgcttcagcctgttccaggatgtctatcgcactctgacaactggcaagaaatcgctcgccatccggtgtcaggctgagccgtcgtgtcgaacgctgaaacagcttcagcccgagacgatcctcaaggcgactgacacttttcccaacagcagatttagtcagtcccagtttttctgcggcagcggtgaaacttccctgctgagccgtggtgacaaaagcagtgataccgccaagatgatctgttcttctcataatttcccgtcagacgtctccgtcctgcgtggtatgccggattgtcagatagcggcccgctgtttcagccagggccaggttcagtttccatgcatctcctggaatacgttatccgggttgggaggatacagagactgttgccctgcgctgagtcataagataacccaaaatagcgcacacattgttgaatctatgtccacagagtggcgaatgaaacccggtttatcatggataaaaaaacaatcatattgatttcctcaataacaatttcgcctccggattcccgaggacaaggaaatgaagatgaatacaaaaaaagatccctctttcattgttggatttagccccaatcacggagggccatagtctggccgatgccttcaccaacagtgtgcgtctggcacgtcaggtagggcttgccggcgggctgacggaagcgcaggcctgtctacttctcgccatgcttgacggcgcagagaccagggcttctgcaacccggacgccaaattttatcgagcagtttttctattacttttttaaacatcttacgtcactttaaggaggcgatgatgccatctgtgaaaggttttaaacatgttggttttcttactcgcaaaaaagggcagagctttgaggattttgtgaaacactgggaagaggttcataccgcaatcacactcaagcttcccggcttgagaggttatgtactcaatcctattgaccgcgaaaaatacccggactcaccagttgatggtttctccgagctctggtttgactccattgaagacgctattgcggcttttgattcacccatcggtaaagcagcatacgaagatgtccccaatttcgtagagagtgccgctattacctatatcactgaaatcagaaagctgtaatttatccgcacctaggcggtgcgctgcccctgaaacgcctaggcgatttttcgtcgaaacatgccataagccgcactgcccgtagtggcagtgatcaccaacagtggccacagactgtgccagataatatcgaaactggcatccttgagataaatctgtttggtgatgtcagtaaaatgacgaataggattgatccaagtgatattttgcagccagattggcatgttctctaccggagagacataaccagaaagcaaaatagcaggcatcataaagacaaatacgccaataaacgcctgctgctgagttgagcataacgaggagatcaatagaccaaaaccgaccagagacaagccataaagcaacatcgtgccgtaaaacagagccaacgaaccggcgaaagggatctggtagaaaaagatgccaattaacaacacaatagaagcctggaacgtcgcgacaatcagtgcaggaacggctttgccgataaaaatctgccatgttgtcagtggtgaaaccaacaattgctccatcgtcccttgctcgcgctcgcgggccactgacagcgaggtcactatcagtacaccgatggtggtgatcatggcaatcaatgacggtactacgaaccatttatagtccagattcgggttataccaattcctgatgaccaactcgctgttattgggtttgatctggccgctggtcaattccaactggtaattttgcacgatttgctgaatataattcgccgcgatctgcgcactgttggaattacggccatccagaacgagctggagctgtgtggttttaccgttggccagatcggcgctgaactgtgcgggaaagcggatcaacagcaaggctttttgattatcaataaccggttggatctcgtgggggctgtgcaggagcagcacattcgaaaatgcggccgctttggcaaaacgttgggtcaactctaccgaggctttgccgctgtcttcactgtaaatcgcgatagtggcattcgtcacttccagcgtcgcggcgaacgggaacaagataacctgcaatattacgggcaaaattaatattgcacgagtctgtggctcgcgtaacagcgactgcaattctttaataatcagtgtgtataggcgatgaaacattttacgcttcctttaatccagccgacgtcgggtcttccaggcggtcaggccgataaacacgacggctgatgcgatcagaaacagcagattaaccaccaaaacagtaccgatatttcccgccagaaacagcgtttgcaggctgctgacaaagtagcgggcaggaatgatataggttacggctcgaacgacggcaggcatactgtcaatttcaaaaataaaaccagatagcattaccgcaggcaaaaatgccgcgttcaacgcgatcatcgcggcgttaaattggttgcgagtcagcgtggagatcaacaaccccatccccaatgtactggctaaaaacaggctggtggtgatgaacaagatccccagcgaaccgcgatagggcacccccagaatgaacaccgataccagcatgcacagcgccatggcgaacatgccaaggacataatagggaagaagttttgatagcagtaattcactgcgtgtgacctgagtagataacagcgcctccatcgtaccgcgctcccactcgcgggcgataaccaacgaggtcaaaatcgccccgatgaccgtcataataatggtgatagcgccgggaataataaagtgtcggctgattgccgcggggttaaaccaatagcgcacctgaatctcaatgagcggatcatttttttgcccagtattctgtgcctgctgctgttgccaaagttgccagaccccttgtgcatagccttgcacaaaattggcggtattgggttcactgccatcggtgatcacctgaatcggtgctttaccttcagggcgcgcgagttgttcggcaaagtcattcggaataacaatgagcccacggatcgtaccggcttgcatggtatgaatcagtgcttcgcggtcatcactgatttgcgcggcaatataaggcgaattagcgaaggcgttagccaaatcttgcgccggtttactctgctgctccagtaaaatgcccacatgcaatttgctggaatcaaggttaataccatagccaaaaataaacagcagcatgaggggaatgaccaccgcgatcagcccactgctggggtcacgtaaaatttgccgagtttctttgtggcataaggcacgcagacgccgccaagagaatccggtgtcttgataagtctcgcccttagctaccggcgaaatattctgctcggccatgggtttactccttatcatgctgttggtcataacgcagaaccaattcgataaacgccgtttccattgacggattggggtcatcatcactggcaacctgttgtttcagttcatcgggcgtaccggcggcgataatcttgccgcgataaaccagcccaatacggtcacaatattccgcttcatccataaagtgggtggtcaccatgacggtgacgcctttgtctaccattccattgatgtgtaaccagaattcacggcgagtgagcggatcgacaccggaggttggctcatcaagaaacaggatatctggctcatgcatcaaggcgcaggccagtgcaagccgctgcttaaaccctaatggcagggagtctggtgtttgtttcaggatcggggtgaagttaaatgccgaaatcatatcggcaattttgtcgcgctgggttttgcctttcagaccataaaccccggagaaaaatttcagattttgttcaacggtcaggttgccgtacagcgaaaatttttgtgccatatagcccagatgttggcgagctttacccgagctggttttcagatccatacccagtaccaaggcttttccatcactgggtaccaataagccacacatcattttaaacgtcgtggatttaccggccccatttggcccgagcaggccaaatatttcaccgcgtttaacctgaaaattcacatggtcagtcgcggcaaaatcgccaaatttcttggttagcgcttgtgcttcaataacggtttcaccagggttgccagccactctgggcataatttttgccagtgcggactcgctgtccgggccaccacctaacaggtcaataaaggcgtcttcaaaacggggttccgcctccttcatttctgcatcgggttgatttagccattgtaataactggctgtgatcgacatctggcttaaggatcagccggacatatttaccttggatcaccccgtcactgacttggggcagggtcagggcatgttgtagcaactggcgattggtgccacgttgggcggccaccaaaatagtccgcccgctcatgcgctgcgtcagggtttgtggtgcgccgctgtacaggaatttgccttcattaagcagcaacacttcacgacattgttctgcttcatccagataagaggtactccacaaaatgagcatgccgtcgtctgccagctcatgcaccatgcgccacagttcacggcgagagatgggatcgacaccaacccccggctcatccaagaggagcactttgggttggccgaccaaggtacaggctaaccccaacttttgcttcatgccacccgacaacttacccgccagacgtgatgtgaagcgggttaaatcggtaaatgtcagcaggcgctcaaatgtctgacgccgaagttcaccggtcacgccacgtaaatcggcatacagcgacaggttttccatgaccgttaaatcttcatacaggccaaatttctgcggcatataaccgagaatggcatgtagctggcgatcatctttcaacggatctagcccgaccacggttatcttaccctgagtgggttttagcaacccggccagcatacgtaataacgtggttttaccggcaccgtccggcccgactaatcccgtcacggctccgctgcggatctccgtagtcaggctggcaaccgcagggtgatccagtccgctgaaccgtttttcaaccgcctccagagtaatgatatgttgaattccattcataactcatgctgccttaacgttggggaaaacgaacagtgacgggcataccttgtcgcaatgattcatccgcatccgtgataataatgcgtaagcgataaaccaggtcggtgcgtaaatccggtgtttccactgtttttggcgtgaattctgccgttggtgaaacaaaaccaattttgccgtgatagggcttatcggggcggccatcggtaaagacttcaacctctgaaccggggatcgcctggcctaaatgacgttcactgacataggctcgaacccagaccgggtcggtcagtgaaacggtaaagacggtattgctggccgataaaatggtgcccggttctactgcacgggtcagtaccgtaccggctgatggggcaagcagtatggtgtcttgcaggttgagttgagcttgcgccagttcggcctctgtttgggccagattcgcctcggcctgagcgatttcttgtgggcggttaccactcaaaaattgtgcgagcttatcttttgctgcttgcagattagcccgcgcttggttgcgtgcggtacgggcattctccagctcattggcggatacggctttactggcccacaacccctgctggcgttttaggaagttatcggcgtagtcaaaggcggcctgtcgctgagccacctcggaccttacttgcgcaatttcctcttcacgataacccgctttcagtaatgccaattgggcttgtgcactttgtacattggcttgcgcctgcttgagcgcatttagataagggccgtcatccaatttccctagcgtttgccccggatgaatatcatctccctcatctactgccagtgaggcgaggcggccagcgacacgaaagcccagatttaccgtgcggatatctacgttaccgtagagggtcagtgacgcgtcattttgctgacgataataatgccagccgtacgctagcgttgctaatagagcgacaataacggcagccacgataatcttcttacgattcataatgtttcctgtctaccactggtttttatcacaatgaaaatgggcgagaggtcataaggttgccttggcccggagtccgttaagaagcagatcaatatgttcaataagtacttgattaattagctggctttcggcctcgccaatacttttccagccagcttgtcggcgaatcgtttcacgtgccagacgaaaagccaaaacctcaccaatcaaagcatgggtatgaataatggttttggttgcactggcatcagtacccgtaaatgcagccagtaattggttcaatgtttggtgtaatggggcaatggcctgagtgtggatcagtgggtaggcttcgcttggcgataattgctcacgcgccatgattttactgaggtttagcgtttcaggttgtgtcattaaatggctgaatgccaataacccttgacgaatatagtgcagttgctgttccggtggctggtgctcagcaggcaactgcaaaaagtgatcaatttcttgtgccagcggtgagaacgcctgctggataaaatcggcaatatattgagcgaccgcaagatagaggccctctttagagttgaaatagtaggtgatcgcggcaatattctgccccgcccgttgggcaatatcgcgggtggtcgcgcctttcagacccaattcaccgaacaactcaatcgcggcttgaagtaactgttggcgggcttgttcacctctggtggtcgccggtgacggcggtgtaacggaatgaggagtcgaatgagacataaataacctgcctgcttaactgttttatgtataagctcaattcatgtataagctaaactagcttgctgcgaatggttagctgaacaataaatcaatcatatgattaaatttaggtcaccgtagtcaacatgtaaagacataggcgatgaaagcctgatttttacggccactaaatcggctttgttgatgtttctgtgactaaagaaattaagatttgtgtaaatatcccttttcttgctaaacatctgttataatccgggtcaatggtgcactgcagtttgtgccaatcctcgtggtaatgcctcaattcatgcctcgtctgataatcttcccttgaaactgcacttggcgatatcgtcaggattgggaagatctggagcttctcgtaatatgtcatttgattctctcggcctaaacgccgacatcctgcgtgctgttgaagagcagggctaccttgtgccgacgccaattcaacgtcaggcaatccctgtagtactggaaggccgcgatttgatggccagtgcgcaaacgggtacgggtaaaaccgctggtttcaccttgccgctattgcaactgcttagccaagatcaacaacccattaagggccgccgtccggtacgagcattgattttgacgccaacccgtgagctggccgcgcagattgacgaaaacgtacagagttatagcaaatacctgaaacttcgctcactggtggtatttggtggcgttagcattaatccgcagatgatgaaattgcgtggtggcgtcgatattttagtcgcgacacctggccgtttactggatctggaacatcaaaacgcggttgatttgtccaaaattgaaattttagtattggacgaagctgaccgtatgctggatatgggctttattcacgatatccgccgtgtattagccaaattaccggctaaacgtcagaatttgctgttctctgccaccttctctgatgagattaaagggctggccagcaaattgttgcacaacccagcctctgttgaagtggctcgccgtaatacggcgtcagagcagatcgcccaaagcgttcactttgtcgataaaaaccgtaagcgtgagctgttgtctcagatgattggcgaaggtaactggcagcaagtgctggtgtttaaccgcactaagcacggcgcgaaccatttagctgaacagttaaataaagacggcattactgcggcggcaatccacggtaataaaagtcagggcgcacgtactcgtgcactggccgattttaaagacggtaaaatccgtgtgttggtcgcgacggatatcgctgcccgtggtctggatatcgaccagttacctcacgtggttaactatgaattgccaaacgttccggaagattacgttcaccgaattggccgtactggccgcgcggaacggaccggggaagcgatttcactggtttgtgtcgatgaacataaactgctgcgtgatattgaacgtttattaaaacgtgaaattccacgtatcgcacttgatggctatgagccggatccaagcattaaagctgatccaattcaaaatggccgtcagggccgtggtgcacaacgtccaggaatgggccgtggcagcagcgcgggtcgtccgcagaatgggggcggtgcagcaggtcgcggtgatagccgcaacagccgcccacgcagccaggctgatggtcaacgccgtccggcaggcccatcgtctcgcggtcgtagccgtaatccaggcgaataagcgatacctcttgggtataacggcttctattcactgataaaaccgcttcttaggaggcggtttttttatcaaaatacggccttaatctgattaaaaaatgtatatataaccattattgaatttaacgttatctaattaaattaaattatagttaaagtctataagggctaattactaaagtttctatattaataagttttttcattaaacataaaatgatttaatttattaaaaatgataattttgtctttttttgaaataataacaattaagttttgatgtgttattgttaatactgattgagaatattatctaatcagaaataaacgaataaaaaactgtttactcatcattaatataaggattttttgtatgccacaagttaataacatatcgacaaacaatacacactcagccggctttaataactcaaattcaattcaaaaatatactggagcagtctcatctataagtgatgatttacgtattaataatgaaaattgcaagagtaatataggaactataagtggtgatataaaaattaatcgccattctgaagtctacggtaatgtgaattcaatcagtggcgatattactgtaaaaaaatctatagtagataaaaatatcaccacagtaagtggtgatgttaacgcggtgaattcgactataggaaaaaatataaaaacagtcagtggttcgattgaggtggaacaatcaactgtaagcggcaatttggaaacaacaagtggtaggatagatatagatacaacaaaaattaacggtaatgtgcatacgacaagtggttcaatttcgctgaatgattcaactattgatggtagcgtaacatgtaaggcggggtctgtaacaattgtcaattcaacaattaaagaaagccttaatgtaaccagtgagaaaataattgttggtacagcatcttgtattggaaaaattaacattcccccccctgaatttgtaaatgttaacatcacgagttttgggagtggtaatataatgatgggaatggggaatctttgtatttcaggaggggtaaatgttaccattactaatggtaaagtatttgttaatgaacaaaggggcggccatacagcttcgcaatcaacttcgaaaaaagtagaagaagttactattaatatcgcgaaaaatgccagtgttaatgatattgttttttatactaaaaagtgccatatcattttagaaggaaatgctaaatataacggagaaaaaaaggatggcatgcaatttacccatgttaacgcaccgaaaagtcatgcttatgcgtaaaatacgtatttagactatctctttggcaatgtccattttcataaatgggcattgcccatgggtattttaccacacgactttaatagccgattttcagtgtggtagaacaaagatgaccaaacaaaaaattttaaggggccaagaatattattattttttactctacgtaatctgtattattcagtgttatctcttgtttttatccccgtttccctcgtatcattgccagccttttttgacattatacgatatagaattaggctggcggtcatgacaaataaaggctctggataatgagtatgcgagtaatactggcaccgatggaaggtgtattagattcgctggtgcgtgaattgctcagtgaagtaaatgattacgacctttgcatcaccgagtttttgcgggtggttgatcaactgctgcctgctaaatctttctaccgcctatgtcctgaattgcacaatcaaagccgtacccagtctggcacattagtacgtatccaattattaggccaatacccagagtggctggcagaaaatgcggctcgagcggtagcgcttggttcatatggtgttgatctcaattgcgggtgtccttcaaaactggttaacggcagtggcggcggggcaaccttgctaaaagatccagaactgatttatcaaggtgcaaaagccatgcgtgcggctgttccggcccatctccccgtcacggtaaaaattcgtttaggttgggattctggtgatcgccaatttgaaattgctgatgccgtgcagcaagcgggggcgaccgaattggctgttcatggtcgaaccaaagaagatggctatcaagctgaacggattaactggcaagccattggtgagattcgccagcgcttgacgattccagttattgctaatggtgaaatttgggattaccagagcgcacaagagtgcatgaaagtgaccggttgtgatgccgtgatgctaggccgtggcgcgctgaatgtgcctaatctgagccgggtggtgaagtataacgaaccgcgtatgccgtggctggaagtggtcaaactactgcaaaaatatgtgcagttggaaaagcagggcgataccggattgtatcatgttgcgcgcatcaaacagtggttggggtatctacgtaaagaatataccgaagcgacagatttattcggtgaaatccgcgcattaaaaaactcgaaggatattgcgctggcaattcagcgtattaatcgttaactcaggaaaataatgtttcaattgaataataatgtggttggaatataaacgtattgccgagaataacgctatgttattgttttttcttgcggctgataaatttagctacccctagcatgaataatgcaccgataaggatgattaacacatcaacccagaacgtcaatgaggccattttttcatcgtgaatatctgctaaacccgcagcaatcaagaatacaccaaagataataccaaaaattgttgttcccatgttcgcccccagagtgccgttttatctgaaaatagatgtggaccattatagggtgatctttaatccgacaggcgtttttttatcattattgagcgtagatttagctcaaaacatcagatattttagataacctaattttataaccggtgagtctggctaaatttattagaacagaaatgtgttaattcgcttttagggttgactgctgcataacaaacagtcaactttaatctttgtaacaatcatttaaagaaaccgtgatgcgtgcgtcaggccggtaatttataatgcgcgacaccaatcatgtccactcccgataatttatttaagctgacaaacatgtatgtaaaaatccgttttgcactattgagctttttgcttttatccaccggtatcagtgttgcgcctttggccattgcccggggatcagcggttgaggttaaagggacggcacctttggaattggcatcgggtagcgctatggtggttgatttacaaacgaataaagtcatttatgccaataatgcagataaagttgtgcctattgcctcaatcactaaactgatgacggccatggtggtattagatgccaaattgcctcttgatgaaattctctccgtagatattgatcaaactaaagagttgaaaggggtgttttcccgcgttcgtgttaacagtgaaattagccgtaaggacatgctgctactgacactgatgtcgtcagaaaatcgtgctgcggccagcctggcccaccattaccctgggggctacaacgcatttataaaagccatgaatgcaaaagccaagtctttgggcatgaacagtacgcattatgttgagccaacagggctgtcgattaataacgtctcgacagcgcgtgatttagccaaattactgatggcgaccaaacagtatccgttaattggccagttaagtaccactaccgaaaaaatggctactttccgtgaaccaaattatacgttgccattccgcaatactaaccatttggtttataacgacaaatggaatattcaactgaccaaaaccggttttaccaaccaggctggacactgcttggtcatgcgtaccgtgattggcaagcggccggtcgcattggtggtattggatgcttttggtaaatatacccattttgcggatgcaaaccgcctgcgtagctggatcgaaacaggtaaagcggcgcccatccctggtgctgccaaaagttatcgtcagcaaaaagattcacagggccgtttagcgcaggtatcagaataagagcagcgcatcgcgactgagaagcggaatttgctagcagaggcaaattccgctttagtgactaattgtttgctttcagataatgcctaagcctaatggtgctatttctggctaatagcttcagtcttgctgccaacgcttacgttttgaggttttaccaatccccggattaaaactgttggttgggtcgatctgttgataaaaatcttttaatgcgggttttgccagatagaggtggccgacattatgttctgcggggtattccgcacctttgtcattgaggagcgataacattttttcttttagcgcttttacatcaacccctttcttaacgatatagtcttgatgaaagacgtggcacagaaaatgtccataatagagcttcgcgatcagacatttttctatttctggtggtaaggtttcaaaccactgtttttcattacggcgcagggcgatatccagtgccaaaatatcttccacttgatcggcgtggaccgcgtgatagcgcactgccgcacctgccgccgcaaaacggtgtagaaaagcctttttaccttcatcagccgtgcaggcaataaagttaccttccgcagtggcaaaaaaggcgcgtagatgttgttgcgcttcggtaataccatcgcctgacattttgagcagcagatgatgttcatattgattacggtaagtcttaaggcgcttaggtaaatggttaggcaatatctgactaaagccttgcattacacgatcggtcaggtgatcgactaaatgcggaattttattgaggcgagcatcaattttaccttttaacgtgaagaatcggggcatgttattggtgcccatactgttaatcatcacaaatgtatctttgccataggtttccgcaatatcaaaaatatcacggtgcagatattcacccgcgataggtaaatgtttaaagtcgcggagaataatacggcgtaactcagtcaatacctgggtttggttggtgccgatataaaaaacttgttgttgtttctcactggggaaggtatccagccgcacggcaaatattgccaatttaccggcacagccggaggcttcaaataaacgtctggggtcggcgttaaaacgcgaaggggtcgttgcatcaatatctcttacccgcgtagcatattcactatctgaggtttgctgcccggtctgttcgatatcttcagcaccatattggccttgttccaaacgttgtagaatctcttctggtgtatttcccaagctgatgcctaaatgattaattaactgcaactcaccttgtgcatcaatttgtgcatacagagccatttcggtgtatgccgggcctctttggaccaatgaaccgcctgaattattgcaaataccgcctacgaccgaggcaccaatacaggaggagccaataaccgaatggggttcgcgaccataaggttttaagcgtttttctaattgattcagtgtgcttccagggaatcctataacttgtttgccatcatccaatagctgaatgttgttaagacgtaaggtattcaagatgacgatagggcgatcataatcatcaccacttggcgtcgagccttctgtcagcccagtattggcggcttgcatgataatgatggtatcagcagccacacaagcctgcagtaactgccattgttgcagtagtgttgacggaaataccacggcgagggccacccctttaccggagcggaaaccggttcggtagcgttcagtctgccgttcaccggtcagtaaatagcgtgtacccactatatgctgtaattgagtcagcaagagctggattttttcattattgaactggctcatcaatgtggttccctgttagtgacattagccttttactgcattagctttttactacatcaaccttttactcccttaaccgtttaatatatcgacgttgattatcgcggttagcggactattgtgattaataattcaacccgcattttgaacaggaggtagctaaagtatagaatcagatctaatggctgtactgattaataaggcattttatgagtgagcattttgttgggaaatatgaagttgaattgaaatttcgtgtcatggatctgacgacgttgcatgaacaattagtcgcccaaaaagcgacggcttttacccttaataatcatgagaaagacatctatctggacgctaatgggcaggatttagcggatcaacagatcagcatggtattacgggaaatgaatccatcaggtattcgtttatggattgttaaagggccgggcgctgaacgctgtgaggccagcaatattgaggatgtcagtaaagtacaaagtatgttggcaacgttaggttatcacccggcattcaccatagagaaacagcgcagtatttacttcgtggggaagtttcatatcacggttgatcatctgaccggattgggtgactttgctgaaatcgccatcatgaccgatgatgccaccgagcttgataaattaaaggcagaatgccgtgattttgccaatacgttcgggttacaggttgatcaacaagaacctcgttcatatcggcaactattgggtttttagccgtcagaaagacgagccgcacagattattttttcattaaagatttcaaattagcaaatgggttatgggtggcgacgccttgatccttttgtgcatcatctccggcaaccacggttgagccgtataaatccacctctgtatatttggaatgctcatgatcgtgacaaaacaggcataacatctcccagttactgccatcttctgggttattaccgtggtcatgatcaatatgatgaaccgttagctctcgcagattggaatagacaaactcccgtgagcatttaccacaaacccaggggaaaattttcagtgccttctcccgataaccgctttccaatcgggaataattctttggtatatatgccatatgagccttcaattctgcgaaaaatatgctgcttattttagcgcgaaagtgggcgtcggactatcgactattgaggataaatactcaaacgccaacacgccattagcacgtttttcttcttatcgggatgtatcaacggcatttactggtattttaccaaaagttatttagagaacttttgagacttttgctgatgatttaaggggataagacgttttacactgtcagtatggaattattgagctaattttattttacggcaggcaataagagcatttacctaaaaccccttgccgatacagttgaggcgctatgaaagaatctgaggtactggccgaagtcagtaatgaaaaccagacattggttgcagtcgtgcaacaagacctgagggtcgtttatttttatatttacccgcaagaagcattcgaagagcgcttcccagtccgtgcttgctgggtgagaaatcgggttgccgcgcctcagtcaaccgataatatggcaatggaacaaggggtggcgccgcgcctggccgcagagttctgccgtaatatcgctggcgaggctgagcttgatccacaatttatttcgattatctggtcagaaagtgatgacggtgcagcactatggtatcaggggcaattactggcaatcatcccaggctggagtttatatattgaccattccatttgctattcagccagttgcatcaaagacaatccgctggtgttgcctcttgggtctgcttcgaccaatacgcaatatgcccttgcgcagcacacacgccaattttggcgacgctggcagcaggaagagggtaatccatggcccctcttgcaaacggaatatattcaatgctatgagcagcattttggtccatcggtaaaatattatgcgatcgatcagggaaaatggcctccaatggcgatatctcagcatgaaaaagaggggatatattattttttgacgattggtgtcagtattcgcccacaaccttgggttgaaatattatttaatgatgatgccagccaataccggcgcatggaaatggcattggctattgatgggcaatatgtcaatgaggataacgctattcatatggccagtgctctggccgggtttgcgcatgttccctggaataaaataacctggttaggtgaggggcataccttagaatctgcagtcgcccctcagggatatgagggctatattttatcatcagcgctctatgctgatgcagaccatcttacattgccccatcagcaggacgatccggtcaatatatattgggctagtcctatttttacccgtgagcgagagcttgcccatagcgtgccaaacggtggctctgatttgttaaaaaaattacagcagcaaggggttaatcatattttctccccgcgccaagccgttatttaggtgatactgaatcagtaccgcggcctgatttgcagattcggtgattcgggtcttaacttaatcaggtcatcgctgttgtttgagactgtctgcttaggcgtaacatgttttgaatcaaccgatatggtggtttagaacatatggggtaagcggaacagtaatcattaattttatggaggcgctcatgggcatactatcttggattatttttggccttatagccggtattttggcgaagtggattatgcctggtgaggatgggggtggatttatcatgaccatcatcttgggtattattggtgcattggtcgggggctatatcagcactttctttggaatgggaagagttgacggatttaatctgggcagctttgtagtggcagtaatcggctcactggttgttctgtttatttatcggaagttaagaagctagtaccggaaactaaaaagccagtactggaaattaagcagctcgctcctgccgctgtcagtggtaatgatttaacatcacagacagtcattaattaaacacacgaaaaaggtggctattttgtcacctttttcacatgcaactatcatcaatatgtcataaaaatatccgttaatggctcatgattacaggcaatctgagagactcattatgggccaggcattacgtaaactcactgcagctgattatccagtagtggtgcaagaaccacgtaaaaaggtacttgctgttaaaggattagtaaaagcatataagtcgcagcaccgtgttctggataatattaattttgaactacacgctggtgagtttgtggcgataattggtcgttcaggtgcgggtaaatcaacactattacatattctaaatggtacgatccctaccagcgcgggtgaaattattaattatcatgaaaatggtgatacacaaaatattgcggcattgacgacaaagcaaatgcgtaaatggcgcgcaaagtgtggcatgatttttcaggatttctgtttggttccccgattagatgttatcaccaatgttttattgggacgtctaagttatacatcgacattaaaatcatttttcaaactattttctgagcaagaccaggccagagccatcgaattattgcaatggctgaatatgttgccccacgcattgcagcgggcagaaaacctctctggtggtcagatgcagcgggtggcgatctgccgtgccatgatgcagaaccccaaaatattattagctgatgaacctgtcgcatcgttggaccctaaaaatacgacacgtattatgaatacgttacagaaaatcagtgaaaatgatattgccgtcattgttaatttacactcagtcgatttagttaaagattattgcacccgagtgataggcattgctcacgggcgaattatctttgatgggccacccagtatgctgaatgacagtattattcaagatatttatagtgatgagtcagccgagcttttacattaattcccatttgtccctttatcataataggttattttaatgaagaaaatattatgccttacctcattgttggctggaatgatgatatttaatgccacggcagaggatgcaccaaaagaaattaatctgggcattcttggtgggcaaaacgcgacacagcagattggcgataatatgtgtgtcaaagaatttttagataaagaattaaatgtaaaaactaatttacataatgcctctgactattctggtgttattcaaggtattttgggcgggaaaattgacttagtattgagtatgtcaccttcttctttcgcatcaatttatatcaaagatcctaacgctgttgaattggtcggaattgccattgatgatacggataaatctaggggttatcactccgttgtggtagttaaagcggacagtccttaccaaaaacttgaagatttgaaaggcaaagcatttggttttgctgatccagattcaacatctggcttcttgatccctaaccaaagtttcaaacagcagtttggtggatcagtggacaataaatacaataacttcttctccagcgtcacgttctctgggggccatgaacaggacattttaggtgttattaatggtcagtttgctggtgcggtaacgtgggcatcaatgatcggtgattatgatactgggtataccagcggtgcattcacgcgcatgatccgcatggaccaaccggacctcatgaagaagattcgaattatctggcaatctccgttgatcccaaatggcccgattttagtccgtagtgctttaccgccagagtttaaagctcagttagtggctgcgattaaaaagttagataaagaagatcatggctgcttcattaaagcgatgggcggtaaacagcatattggtgagacgtcacttagtgagtatcaaaatattattgatatgaagcgtgaattaaccaaaggcgatcgttaatttggcccaacggataaaacaacatggctctggttcgccggagctattgtttttaggtgtggcatttttttaggtataacatgacttttaggtgtagcttattttgaagactgactttaaccactattatcagcagattcgtagcaagcaaaagcgtgatacggtgatttggtcgctgatgctggccatcatttatcttggcgcaggtaatattgctgagtttaatctttataccgtttttatttctatcccaaattttttcgattatttagcggaaaccataccggttcttcattggcgtaatttatttgccgatggaaagaccgaaggatctctggcttattggggctatcgtttacctatccaattgccgttaatttgggaaacgttacaactggcggtcgccgcaacacttttatccgttatggttgctactattttggcgtttctggcggcaagcaatacccaaagcccaccgtggttacgtttagcggttcggacgtttgtgacttttctgcgtaccatgcctgagttagcgtgggcggtaatgtttgtaatggcttttggtattggtgccattcccggttttctggcgctggccttacatactataggcagcctgacaaaattattttatgaatcactggaaaccgcttctgataaacccgttcgtggattagcggcttgtggggcaagtcaattgcagcggatgcgctttgcgctgtggccacaggttaaacccatattcctctcttatagctttatgcgattagaaattaattttcgacaatcaactattttgggattagtgggtgcgggcgggatcggacaagagctaatgacctcgataaaactggatcgctatgatcaggtcagcataacgttattgctgattattattgtggtttcactgttggattatacatccggtaaattgcgcaaacgagttgtggaaggagcatgataatgttgactcatcatctgacaacagaacagatattaacgctgaaacaacaaaatccgcagcttttcaggcagcagaaacgttatatcagattgattgcgataatcactgcggctatttttttgtattaccttttcttctttactgtttttggtatcccttggcaaacgcttgttaatggtagtcagcaactcagtcgctattttttacgtatgtttgtctggcatgattttgctaactggccgtttaaatattatttgggtcagattttcattaccttggcaattgtattcgctgggacattaaccgccacattgatagctttacccctgtcattctttgccgcacgtaacgtgatgtcgacaccgggtttacgtattatttcatttgcagtgcgtcgtttcctggatgttttccgcggtattgatatggcgatctgggggttgatttttgtccgcgcagtaggaatggggccactcgctggggtgctggccattattatgcaggatgtgggattactgggtaaactctacgctgaaggacatgaggcggtggataagtctcctagccgtggcttaaccgcaatgggagcaaattctttgcaaaaacatcgttttggtatttttacacaatcctttcctacgtttttggcattaagtctctatcagcttgaatctaatacccgctctgctgcggtgttaggttttgtcggtgctggggggataggtttagtttatgcggagaatatgcggttatggaattgggatgtagtgatgtttatcacattgatcatggtcgttattgttatgatcatggataaaatatcagcgatattacgcaagaagtatattcttggtgaagagattgcattatatcagccataacaatttatataatgatagagagtagattggtgtgataaacaaattcttatcaatttattttttcagggataatattatatccatataaaattcaattaatttaaaataacagttgattaaatttacattgagaaaatcaacataaatctgtacaatactgcccgctagacgtcaaagacgctcttttagtttttttgcgatattcgcacacgtctactctacataataggaatagggcagtaatatgatcaacaacgatgtgctccgcagtgttcgctatatgcttaacgttaacgataccaaaatagcagaaatcattaagctggctgattttgaagtgaacaacgcagatgtcgttaattttcttaaaaaagaaggcgaagccggttatcaggattgccctgatctggtgatggcgcattttctgaatggtttgattttctttagacgtggtaaagatgataagttccctgcacctgcggtagaggcggttatcaccaacaatattgtgttgaaaaaactgcgtgtcgcattcgaattgaaagacaccgatatgcatgatgtttttaatgccgttgaattcccagtctctaagcctgagttaaatgctctgttccgtaaagagggcagcaaaaacttccgcccttgtggtgatcaggttttacgttattttctgaagggcctgacactgcgtattcgtggcgctaaaaaagcctagaaataatgttagtggcgagtcgtcaataaaggttggtcgttaatagttaatagttaatagttaatagttaatagttaatagttaataaaggctagtcgttaataaaagctagccgcgagtaaagtctagctgttagtaaaaaaacaggtgtggtaatccgccatgcctgtcttaggttaatatacccgtcatacttcatgctgcatcagtgactgaatttactcatatcatttccctctctgcttttctcattactatatttcacgtattgcaccgtttatgcccttggtttgtacattattggtgcagatagtctgattgtttatccgtatattccgccgtcttggacgtaatagtcaattaaatcatcaaagtacagacttggcatggcaattgcgctggtttaattcaattttgcgtgtttactcaacgatcagaggttaacgctatgcaacgtcgtaacttgattaaagtttttgcgctctcggcttcggttatcagtatgggaatggcatttggcactctggcggctgacaccattaaagtgggtattttgcattcgttgtccggcacgatggctatttctgaaacaccgttaaaagacatggcgctgatgagtattgatgatatcaatgcccatggcggtgtgttgggtaagcaattggaacccgtgatcgttgatcctgcctctaactggccgctgtttgccgagaaagcgcgccaactgttaacacaggataacgttgccgtggtgttcggcggctggacatctgtttcccgtaaatcggtattaccggtatttgaagagttgaacggtttattgttctatccggtgcagtatgaaggggaggagatgtcgccgaatgtgttctataccggtgccgcgccaaaccagcaagccattccggcggtagagtatttattgagcgaagagggcggtgcggccaagcgctttattttgttgggaacggattatgtttatccgcgaacgaccaacaagatcctgcgggcatttctgcacactaagggtattgaagataaagatatcgaagaagtctataccccgtttggctacagcgattaccagaccattgttggcaatattaagaagttttcagccgggggtaaaacggcggtgatctctaccattaatggtgactctaacgtaccgttttacaaagaattagccaatcagggcattaaagccaccgatgtaccggtgatcgctttctccgttggggaggaggagttacggggtatcgataccaaaccactggtcggtaacctggccgcgtggaactacttccagtccgttgataacccaacgaataaacaatttgttgaacactggaaagcctacgccaaagcgaacaagttacctaacgccgatagcgcagtcactaatgacccgatggaagccacttgggtggggatgcacatgtgggcgcaagcggtggaaaaagcccaatcaacggatgtggataaagtccgcgcagccatggcagggcaaacatatgccgccccttcgggttttacgctgaccatggaccagaccaatcaccatttacataagccagtcatgattggcgagattgaagcggatggccagttcaatgtggtatggcaaaccgatgcgccaatccgtgcccaaccctggagcccgttcatcgcgggtaatgataagaaacccgatcatccagtaaaaagcagccagtagccatcaaatagcgaacaacggtagacagatgatcgcggtaaacaggtaatcgctgtgacgtgctgatgtcagcgggatctgacgtcagctctttttcaccacatatgtgtgatgagtgggcctatgaaatcgttaattcctgtttggaatagggcaatcaattatgtgttcaggccgatgataggtctgttactgggcttatcgatgtcggcaatggcagggccagcacaggattttgttgcggcgaatcgtgcacagcaggccacattattacaacagtgggcaacggaacctgatgctagccgattacctcttttgcaggcgctaaaacaagaaacagtagtggtagacagtgccggccaagcgtttattaaaaataatcaaagtattaattcgctggaaggccaatcgcaaccgaccggtacgctgaaaaaaatctggctcaacaaccggttacgtatcttgatcgccaatgccctggcggcacaacgcttagtcagtgacgatgaaaccgtgcgtttacaggcggcagttgaattacaacggcaggcacagagcgatcaactaccgctgctgaatcaacgcctgaagttggaaacggacagtcaggtcaaagaggcattgagcattgcactcgccaatttacaactgacggacagtaatccgcaggtgcgtctgaatgcagtgcaattgttggggcaatcaggttcaccgcaaactcaatcacggctgcaaagtttaaccgatacgcaggttgaaccgaatgaacaggtccgagccgcagcagccaccagtttgaaacagatacaacatcggttgatgattggggaggttattgggcaggtatttagcggactatcattgggttcaatcttactgctggcggcattggggttagctatcacctatggcttactgggggtgatcaatatggcgcatggtgaaatgctgatgttgggagcctattccgcctatctggtgcaatcgctattccaacaatttgccccacactggctggcactttatccattaatcgctctaccggttgcgttctttattactgcgggcattggtatggcgttggaacgcacggtgattcggcatctgtatggccgcccgttggaaacactgctagcgacgtgggggatcagcctgatgttgattcaggggatccgcatgttgtttggcccacagaatttggaagttgctaaccctgcatggctgtccggtggggttcaggttttacctaatctggttttaccgtggaatcggatcgcggtgattgcatttgtcattattgttttgctactcacatggttgctgctgaataaaacccgccttggtctgcaagtccgtgcagtgacacaaaatcgggcaatggcggcctgctgcggagtggctacggggcgggttgatatgctggcattcggtttgggttctggtattgcagggcttggcggtgtagcactctcacaattgggcaatgtcggcccggaattagggcagggttatatcatcgactccttcttggtggtggtcctaggtggcgtcgggcaattagctggcagtgtggttgccgcattagggctggggatgttgaataaaattttggaaccacaaattggcgcagtattgggcaaaatcctgattttagtgctgatcattttatttattcaaaaacgaccgcagggtctgtttgcccttaagggcagggtgagtgactaatgaatcaaccactgacggtaaccttaacgcaaaaagcaccgcttaccagcctgttattaggtatggtcacgctgatcgcactgattgttctgccttttttggcgctgttaccggcggatcatccgttggcgatatcaacctataccctgacgctgatcggcaaaatattatgttatgccgtggtggctatcgcccttgatctggtttggggatatgccggattgctatcacttgggcacggattattttttgctctgggcggttatgccatggggatgtatctgatgcgtcaggctgcgggagacggtttacctgcgtttatgtcttttttatcgtggtctgagcttccttggttttggagcggcagtcagtactttgtttgggcattgtgcctaattgtactggttcccgggttgctggcttttctgttcggttattttgcttttcgctccaaaatcaaaggcgtctatttttctattatgacgcaggcgctgacctacgcgggtatgttgttatttttccgcaatgaaacgggttttggtggcaataacggctttactggcttcactacgatgctggggttccctgtctcggccacttctacccgtatcgcattatttctggcaaccctcgcactgctcattgccagtctggcgctggggctggcattagcgcgcactaaatttggtcgggtattgacggcggtacgcgatgccgaaaaccgcctgatgttttgtggttatgatcctaaaggtttcaagctgtttgtctggactctatcggcggtactttgtgctctggcaggagcattatatgtaccgcaggtgggcattatcaatcccagtgaaatgtcaccgaccaactcaattgaagcggcaatttgggtggcactagggggccgaggaactctgatagggccggtattgggggccggaattgtcaacggtgccaaaagttggttcaccatggcgatgccggaatattggcaattttttcttggcctgatattcattctggtcacgttatttttgccgaagggggttattgggctattgcgcagggggaaagaccaatgagccggtttcaactgacggagcaactgattcatgccgagataaatgttcaggagcctggaacgatacagcatgcggctgatcaatatcgccagcagcgcgatccggtactgacgctggaaaacatcaacgtcagctttgatggttttcatgcgttacgtaatctttcattacaaatcggtgttggggagttgcgttgtatcattggcccgaatggggcggggaaaaccacactgatggatgtgatcaccggtaagacgcggccacaaacaggcaagatggtgtatgaccaacaccatgatctttccaccatgaataccattgagattgctcatgccggtattgggcgaaaattccagaaacccacggtatttgaggccttgagtgtctttgaaaatttagaactggcacaaaaaaaccataaaacggtgtgggccagcttgtgcgccaaactcaacagtgaacaacgggatcagattgatgaaacgctggccatattgcgtttaagtgatctgcggcagcggcaagcggggttgttatcccacggtcaaaagcagtttcttgagattggtatgttgttggtacaagacccgcatctattgttattagatgagccagccgcaggaatgactgatgccgagacggcgtatactgctgagttgtttaatcagttggcgggtaagcactcgttaatggtggtggaacacgatatggggtttatcgagacgattgctgatcatgtcactgtgttgcaccaagggcaggtgttggccgagggatcactggcagaggtacaggagaatgatcaggtgattgaggtgtatttagggcgttgactcagtgtagttcaatgatgagcgcgttatttggagaatgtcagtgagcttgcatttttccctcatatttatttgataattaagggcgcttttatgctgcaagtgaatgagattgatcaatattatggtggtagccatattctgcgcggcttgacttttgaggcccgtgtgggggaagtcacttgtttattgggccgcaatggtgtcggcaaaaccacgttgctgaaatgcctgatagggcttgttccgattaagaacggcggcatcacttgggaggggaaaaatattagccaccagtcgccacatcagcgggtcaaagaaggcattgcttatgtcccccaagggagagaaattttcccccggcttacagtggaagagaatattttactggggctttcacgtttccccggttcacagagtaaaagcgtacctgaacatatctatcaactgttcccggtgttacaagagatgaagcatcgccgtggtggcgatttatccggtggtcagcagcagcagttggcgattggtcgggcattggcgtgccagccccggttattgattctggatgagccgaccgagggtattcagccatccgttatcaaggagatcgggggggttatcaaaaaactggcggctcagggggatatggctatcctgctcgtggagcagttttatgattttgccgccgagctggcggataactatttggtgatgtctcgaggaaaaatagtccaacggggattaggtattgatatggaacatgatgatgttcgccgtttggtggcgatttagctccatttagacggctgctcgtcaataagacaatatctcatcatgttatcccttagcagaattatcgtattatttaaaatgatagggtttctaaattaatggagccaaatcattgtgactagtttgtcaataactgctaagcaattcaaaccctccattgctgaggagcctaagattgccaggctaaaacagcttgatcggcatagtttggaacaattaatccgtggtggcatcctggcaattcgtattcccaattactgccctgaaaaaaccgctgcatcattaaatcaatacattaatcaaaccgcaaagctggatgaatacacccatgaggtctatgaaaaagaccaggtggtacaaaatttttacggtgtccaccgctggggaacgccattcaatacgacctacggtaaagctgaaaacgagagtgcaaagcagaagtattatcgtgatgcagcccagatgcgcatactgattgaccgtctttgcgctccagatttgccgccaattcaagcgttaatcgaaaatattaaacagcactggccagagggcgtagtgactgcctcttttgaagggaaaccgatgtttgccggtatcattcgcgtgatgtttcctgaaacggcgcatctatccgaaacggttccacatgtggattgcctgccattttccgttgccgagttagagcatcaattcagcgctaatatttatattgatacaccacctgttggcggtgaattagtcgtctgggatactgaggccttttccttcgccgaagtcgcgctatttgagggaggaaaactgcccgaagagcctttgcagcggcctctgcgcattcaaccacagaaaaatgagctggtgatcatcaatacccgccgccctcacgccatttgcgggtttgattcaggcaaacgaatcagcatgcagtcatttataggttacaacacgaaccagccgttctatttctggtgttaatgacttcaaaatgagagctttttatgactcctgaagagtttcgccgccatggctatgccatgatcgacctgattgctgattaccgacaaaatatcgaattgcgtggcgttaatcccacgacagcacccggtgagattaaatctcgtctgtcgttaaatgcacctgaaaaagcagaacctttcgaacacattatttctgacatagaagagctcatcatgccagggctattacattggcaacatcctgacttttttggttattttccttctaatgtagagttatcctccgttcttggggattgcttgagtactgggctgggggtgataggtctgtcttggcaatccagcccggccctgacagaaattgaagaggtggccaccaattggttgctaaaaatgcttggtcttagcgttgcctggagtggcgtgattcaggattccgcctcaaccgccacgttagtggcgctgatcagcggccgagagcgaacatctaactatgcattaatgaataaagggatgcaaaacagtgatgcacctttgattgtctacacttcatcagaagcccatagcggagtgaataaagccgctctgctcgctgggtttggtcataataatacccgtttagtgcccaccgatgagcacaatgccatgtcacccttggcattaaaaaagatcattcaacaggatttggtgaagggaaaccggccttgtatcgttgttgctacgacaggtactaccgctgcgacagcgatggatccccttgatgcgattggtgatattactcagcgttatggtttatggctgcatgtggattctgctatggctggttcagcgatgattttgccagaatgccgtcatctgtggtgcggtatagaaaaggctgattctgtggtgataaatccgcataaatggctgggtgctgcttttgattgttcggtttattgtgtacaagattcagagcatttgattcgtatcatgagtactaaccccagtttcttacaatccgatgccgatgggaaagtgagaaattaccgcgattgggggatccccctgggtcgtcgttttcgtgcgcttaagctatggtttctaatccgtgagcaagggggggaagggctgcaggcgcgtttgcgtcgtgatattgccaatgctaattggttagcagaacaaattaaaaacagcgatgattggaaactggtcgcacctgtagtgttgcaaaccttgtgtattcgtcatgaaccgggtgggctgatgggcgacgcgttggataattatacccgcagttgggccgagaaactcaatcaatctggtaagggttatgttacaccagccacgcttggtggccgctggatggtgcgggtttccatcggcactttgggtacggaacgtcatcacgttgagaagttgtggttgttgttgcagtctttggttaaggagagataaaagggccttaccatattaagaattgagcaatgagcaatgagcaatgagcaatgagcaatgagcaatgagcaatgagcaatgagcaatgagcaatgagcaatgagcaatgagcaatgagcaatgaacaatgaacaatgaacaatgaacaatgaacaatgaacaatgaacaatgagtcatgtcagtggctggtggtgagccagcctttggtatcacgccagaggcgttgcgtctattggtagagagtttgacgccccccattcagcccaagagccatcatagagtgacactgaccgtgcattcaccgccgctagacccagtaccactaccgctgcggtgacccctgaaccacaactggtaataatgggcttagttaaatccaccccttgagccgcaaatatttctgccaatgcctgtggtgacttcagatgaccattctccaccatggtcccccacggcatattgatgctgccagggatgcgcccaagacgcaaaccagggcgtggttccggctcttgtgctctatatcttgctgatggccgagcatccaatatttgcacctcattattacccagaaccgccagtacctcatcgacactagaaacggcggcggcattgaaagtgacattgaaggtttgtggtgtagggtgtgcagggccactttccagcttatagcctgcttgttgccacccgctcagaccacttgccagaatacgcacatttttagcgccaaatgtgcggaacgtccaccacacgcgtggtgcagaaaacagattaccctcatcataaatcaccaccgtgtgttgttcagtgatgcctaactgccctgccatttcactgaatagctgaggagagggcagcatatggggtaagccggtactgtgatctgctattgcatcaatatcaaaatagaccgcgccgggaatatggccctgttcaaactcagcctgaatattacgtttggggaccactccgggaggcgacattctggcatccaaaataactatattggcatcattagcatgtgctgcaagccattgcggtgtaaccagaaaatctgagttcataacatattacctatcaaagttataagggggtaattccgaggataacgtcatcgggtgactcactatataacgaaataattgtaattaaaccccgacttatcaatgatgcgtaatgtttcgcatttattggtatttattatttaatgtatttcataccgtaagcaaataattcgttgttgcgtttggaacactctcgtttttgagcggcgtgcagaagtttacttcctgcttctatcgtcttgtattaagttgagtagagatttcttcgtgctcttgccagtatcgtttttcctgtcattggcttgaaagtggacgattaatcgggatatttaactgttgttatatacagctttttgtgtaatgttaataaccgatcttgcttgggtgaacggctttaaataattatctatcatatggttatagtgaagatgattgatcgctgaaacgagaataatatatttaatatcagttggttatttagtgtgttttgggttaaatctaatagggcgacgggtaggttaataagctaacgatatctccctactgcccagatgttttataaaccaattggccttacatgcccaaaataatttgagtttcaggaaggtagcaacaacgcggtaaattggtcgggctggtttgaatcgcatttatgctagcccgtagaaccaccaacgttcaggcaacatgaagaaacttgaagtataacggggataaactgataagaggtgacgtatggcactgttcctaactcgtagccggatttttgcagtggctgctatcatgctgtctgcatcgagtggtatatcgcacgcggcagataacgtccgtgtaggctctaaaattgataccgaaggctccttgctgggcaatattattgtgcaggttttggaggctaacgggattaaaaccaccaataaatcccaactgggagcaaccaaagtcgtacgtggggcgattactgccggtgagattgatatttatcctgaatatacggggaatggggctttcttcttttctgatgaacaagatcctgcctggaagagtgccaaagcgggctatgagaaagtaaaagcgctggattacgaaaaaaataaattggtatggctctctcccgcgccagcgaacaatacctggaccattgctgtacgaaaagacttagccacggccaataatttgcgaacgctggatgatttaggtaagtggatcaatggcggaggtcagtttaaattagccgcctcagccgagtttatcgagcggcctgatgcgttacccgctttccaacaggcgtatggttttacgctgaatcaagatcaactactgtccctggctgggggagataccgctgtgacgattaaagcggcagcagaacagatctcaggagtgaatgccgccatggcttatggtaccgatggtcctgtagcggcactgggtttacagactctggaagatactaaaggcgtgcagccgatttatgcgccagctccaatcatccgtgaagttactctgaaagctcacccgaacatcccggctttgcttaatccggtattcgccacactggatggcccaacgttacaaaagctgaatgcacgtattgcggtggaagggcaggatgcaaagaaagtggctgccaattatctaaaagataacggatttattaaaaactaaccattagctgggggagccagccgaccagtgtggcactataagcttattcgttttatggtgctattcgtttcatggcgccatccgttttatggtgccatcaaagagactcagcgtagttgtaaatataaatacagttgtaaatgtagctgtaaatataattgtaaatatagctgtagctaacgccctacagcttcaagtgagaaagtagacaggtaatccgcgatgacacataaggttatctggtatggagatggatttttatggttgtaaaaaaccgggttttgctaacactgtctattttattggttttagcaggcgcggggcttgcctttcttagtcatgctcctaatcgattgatttccggacaggggatcatgctgatatcgctaataaccggtcctgtcctgtggctgttagcaccgatactggggttaattatctttgcttttctcactcccagcatcgccctctattggttgattatcttgtttgcagagctgctgttattgggtttactgctattggcgggtgccaccgcaactcaattggccggaggcgaagagagcctcgtccgcacgtcattaggtggcgggttttggttgatgagtggggtgagtctcttgattgctatcgacagcttatcccgcgtcattgctcatccagtctggcgcagtttagccattgctttgttgatgctaccaatcattgcattgctggcaagtgggcaattagatcaactgtcattaatgaaggaatatgtgaatcgtcgggacgtatttgatgatgccctatggcggcacatccaaatactactgactacgttagttccggcagtggttatcggcattcctcttggtttactttgttttcactctcaccgtttacaaggcgctattttttcgacgctaaacattattcaaacgatcccatcgattgctctatttggtttgctgattgcaccattgtcagggttggccgcagctatcccttggcttgctgaactgggtatcggtggcattggcttagcgcctgcaattatcgcactggtgctgtacgccttattacccttagtgcgtaatgtggttgccggattagaggctgtccccgacagtgtggtggagtcagccaaaggtatggggatgacacgccagcagttattctttcgggtacaaatgccgattgccatgccactcattctgtctggtgtccgcattattgctgttcaaaccgtggggttagctgttgtcgcggcgctgattggtgcgggggggctaggggccatcgtattccaaggtttattaagcagtgctctggatttggtactgctcggtgtgatccccgtgatagcgatggcggtcattgtggattcactgtttaaattcattgtcatatttatggatatttcacgtcgatgattcaattccatcaagtcagtaagtattttgccggtaaacgggcggtagataacctatccctacagatttctaaaggggagtttaccgtgctgataggtacctccggttctggtaagtcaaccaccttaaaaatgattaacaggttgattgaacacgatgaaggaaaaatccgttttgccggtgaggagatccgtaactataaacctgaagatttacggcggcgcatggggtatgcgattcaatcaatagggctatttccacattggacggtagaacgcaatattgccacggtgccacagttgctgaaatggccaaaggatcgtatccgtcaacgtgttgttgaactgctggaactgttgcatctggatccacaacagttttgtcaccgctatcctcatcaattatctggagggcagcaacagagggttggggtcgcgagagcgttggcggtggatcctgaagtgctattgatggatgaaccttttggtgcgttggatccggtaacgcgttcagcgttgcagcttgaaattacccgtattcatcaattgtcggggcgcactatcgtgctggttacccatgatattgatgaggcattgagtctggctgatcgcatcgttttgatggatgaagggcgagttattcagcagggaacgccccttgaaatgttggcccagcctgccaatgattttgtccgtgatttctttggccgcagtgatctcggtattaaattattgtcacttgggcgagtagaacaacgtgttagatgtggtgaaacgctggcagggcagccgatactgggtaccaccagcttgcgcgaggcactttccctgtttgtttcccgtcagacggataaattaccggttgctaatgaacacgggcagccactaggcgttctctattttgctgatttggttgcgaataaggaaagagtatgaagccagcagaaaccaaacctgataatacagcagtgggtgatgtgaaaagtattaaaccggggctgcggttttggttttggctaaaagatcctctgtgttgggcgctgctcatcctgtgtgggttggtcttcggtatgacctcactacagcgtttctttaccgcattgttcccagaacttgatcggcctatctatttgcaagatacctttttttcattggtggtcgctcatgtattactggtattggcctccagtagtattgctgttttcatcggtgttactaccgggattgcagtaacgcgcccggcaggaaaggagtttcgttcggtagtggaaacggttgtggcgatggggcaaacatttccccctgtagcggtactcgccattgcggttcctgtgatggggttcagtgagaaaccggcgattattgcactggtgctttatggcttattgccgattttacaaggcaccattgcgggtattgaatccgtttcgaccagtatccgtgaagtggcggcaggtgttgggatgagtgcgaggcagatcctctggcaggtggaattacctttggctgcgccagtgattgtggcgggtattcgcacttcggtaatcatcaatataggtactgcggctatcgcatcgacagtagggaccaagacgcttggctctccaattattatcggcctcagtggctttaataccgcttacgttattcagggggccgccgttgttgcgctcttggcgattattactgatatgattttcgaccgttggactcggcggttgtcacgctggagggaacgacactctctttctgctccccgaacggattaatgatgctatcaatggcgattaatggtgttaccaatggttctccttgatctgaattatcgatgtgagccagtggttcggtattcactctttttacttggtcgtaatagtaatagtaatgactttggatctggtgcttgcctgaatttatcaatattactattaatataagttaaaaccattccccatggaataatgataatttaactcatgtaatttattttgatgataatattttaatttgtgtattaataattaccttgtgtgtttattgttgtgaaatacactgtaaatataatttgtagcaaagtaattaaaatcaatcgccaattatccattgtgtctatttatatttgtttttaactttatttataaaatatatcgtctacctttataactgcgtctggctattcatcatcattttcagcctattatagggatttgtaaggattacctatgtctacagatgatcagaaggtagggttaattcctgtaacccttatggttgcaggaaatataatggggtctggtgtttttttattaccggcaaatttggcttctacaggtggaattgcgatatggggatggctagtgactattattggtgctctagcactatcaatggtttacgccaaaatgtcatctttggatgatagcccaggggggtcttatgcttatgcgcggcgtgcctttgggccatttttaggttatcaaacgaatgtcttgtattggttggcatgttggatcggtaatattgcgatggtcgttattggggtcggctatctcagttattttttccctattttaaaagaacccatggtattaacgattacttgcgtagtatttctatggatatttgtcgggctgaatattattgggccaaaaatgatcacccgtgtacaagcagtagctacgtcactggcgcttattccgattgtgggtatcgctttatttgggtggttctggtttaagggcgaaacctatatggcagcctggaatgtcagtgggttaggtacctttggtgcaattcaaagtactctgaatgtgacgctgtggtcatttatcggcgtcgagacggcatcggtggcggcaggggtagttaaaaatccaaaacgtaatgtcccgattgccaccgtgggcggggtgttaattgcggctgtttgttatgttctttccagtagcgccattatgggaatgatccctaatgcagaattgcgtttatcagcatcgccatttggtgatgctgcccgtttagctctgggagatacggcaggggcggtcgtttcactctgtgcggcggcggggtgtttagggtctttaggcggttggacgctggtggccgggcagacggctaaagcggcggctgatgatgggctgttcccccccattttcggtaaggtcaataaagccggtacgccagtggccgggttacttattcttggcgtactgatgaccattttccaaattagcagtatttcgccgaatgcggccaaagagtttggcctggtttcttccgtttctgtgatttttactctggtaccgtacctgtatacctgttcagccttattactggttggtcatggccatttaggcaatcaagtgaaaacgtatgtcggcataacccttattgctttcgtgtattgcatttgggccgtagtcggttcgggtgccgaggaagtgatgtggtcatttgttaccttgatggttatcaccgcgctttatactttcaattacaaccgtacccacaaaaacccattcccactcgatgcacctgttaagaacgggcagtaatacccactcccatctgtagctgggtgggcatcattgatgtgatgaattatagataaagggataaatacgatgattgatttaagcagtcacaagaaacgcaacgttttagtggttgacagcaatattcgtgatatcaataccgctaatggtcgggcggtaaacgaacttatcattgcgcttaatgacattaattttaatgtgattgcggcggcgacgtttgaagatggcgcggcaacagtgatctccgactcttcgttgtgctgtatttttgtcgattggacttcgggtggtaatgatgatgaatcccatagtcaggcatttgcattgctacaagacattcgtcgccgtaataaatcagtgcctgtgttattgatggctgagcattcatgtatcaatagcttaagtttggagaccatgcagcttgttaatgaatttgtttggatgcatgaagatacctccgagtttatcgctgctcgtgccaaagcactcatcatcaagtattaccagcagttgctgccgccttttacgcaagcgctgtttcaatatacgcaagataatcctgaatattcatgggctgcccccggtcatcaagggggcgttgccttcagtaagacggcggttggacgcgagtttcttgatttctttggcgagaatctatttcgtacggatactggtattgaacgtgagtcattgggatctttactggatcacagtgggccgataaaagagtcagaagcgtatgccgcacaagtttttggtgcacatgcaagttactcgatgcttaatggcacatcgggctctaatcgcgccattatggccgctgtcgtgggagataagcagatcgcattgtgtgatcgtaactgtcataaatccattgagcagggattggtcctgtcgggtgcattaccggtattttttattccaacccgtaaccgctatggcattattggaccaattcctaaagcacaattccaacccacggctattgcacaaaaaattgaacaaaaccccttaaagtcattggcttgtgatagcaagcccgtctatgcagttatcacgaattgtacctatgacggtatgtgctataacgcccaacaggcacaggatttattggcaaaaagtgttgatcagattcatttcgacgaagcttggtacgcctatgcccgttttaatcccctttatcgggagcgttttgcgatgcgtggtgacccggctgaccatgatgcgctgggaccaactatttttgctacacaatcaacgcataaattattggcagcgctgtcgcaagcttcttatattcatgtgagaaatggcaaaaagccgatagaacattcgcggtttaatgagtcgtatatgttgcagtcaaccacttcgccattgtacgccattattgctgccaatgaagtgggggcggcgatgatggaaggcgggcaggggctagcattgacacaagaggtgatcgatgaagctgttgattttcggttggcgctggctcgtgcacatgatgcttttgcaaaacaaggcgaatggttctttaaaccttggaatacaccggaaataacggatagcaaaagcggtaaaaagttacctttctcccaagcatcacgagagcaactgacaaccgatcccgcctgttgggttctcaagccgggagacccgtggcatggtttcgagcagttggaagaagattggtgcatgttggatccgatcaaggccgggattatggtgccgggaatgggggatgacggtaagttgtcagaaaagggaattcccgcagcgatagtgaccgccttccttgggcagcggggaattgtaccgtcgcggaccacggattttatggtgctgtgcttgttttcggtgggtgtaacgaaaggtaaatggggcacactcattaatgtgttactggaatttaagcagcactacgatagcaatacaccgatatcggtgtgcctacctgacttggcgaaaaattatcctcatcaatacgctcataaggggttaaaagtgttgtgtgatgagatgtttgcttatatgaagatcagtgaaatggataaactgcaagctgaggcatttagccatttgcctacgccagtggtcttaccccgtcaggcttttcaagatcatatggctgggcggtgtgagctactacctatcgataagctcgctgggcgtgttaccgctgtcggggttattccatatccgccgggcatcccaattgtcatgccgggggagagttttggtagccatgaagaaccatggctacgttatatcttaagtatcaccaaatggggtcagcattttcccggcttcgagaagatcttggaagggtccgagcagaagaatgggcaatattttatttgggtactaaagcagtaaatgcgcctagggcgggtctctcaccgctgctccgccctaaagctgtcagcccaaaatacggccagtcaaaagaaactgtcagtcaaaagaaactgccggccaaaaggggataacagtttacggtgattcctggccggtgttggataaaccggctgggccgatgccaggcaccagagaggtttcagtagcgtcagtttcagtaacatcagcttcagtagcattggtttcatgtggcgtcgttgagcgggtgtagatgttcagccccgccaggaaaacgccccctagtgaacttagcgccataaccgcaatcaggataatgagtgtttttctcagcataataattattttcactttttatctaaacagtaggaattatagtccgttcgcggtatgaaacaaccgtgttatataattgctacgtaatgatgatgagtatgcaacagtgatttgcacgtagagattaacggcgtgtgaacaaaaattttcccaaagtgaccaatactacggcagaaacaatcactgccagtgcgccccattctgtgggagataagctttcgccagcaaaaccaatacccagtaacaccgctacgactgggttcacataagcatagctggttgcaaccgctggccggacatttttcagcaggaacatataggcgctgatagcgagcattgagccaaaaacaattaagtacagtaatgcgagaataccgctcatcgtcggaggttgctgtagcttttcgccactcagtgtactggcaagcagcaacacgacacccgccactagcatttgtgcggcaccagacatcgcaccggctggcaatgctaaccgggagctccagactgaaccaaatgcccaactggcggaagccagcaatatcagcatggcccctaccgggttgcccaataggttgctgccggtgttgagtaatatgataccaaccagtccgagagcaatacctgcccattccagcttagtgttacgcattccccataataaactgaagcacaacgtaaacagaggaacagtcgccaccatgactgcagcaataccggaaggaacatgttggtgctcagcgatggtgactaatccattaccaattgccagtaataagataccaatggcactggctgctgcccactgccgcaaagtgggcagtgcatgaccgcgaatagcaaggaaactgaagagtaaaacgccagcaattaggtaacgtagtccggccatcatcaatggtggccaactttctaccccaatgcgaataaccagataagttgaaccccagacgaagtacaaggtaaaaagtgaaccgatcaacaaccacaggttacggcgattttgcttcagcatagttattcaacgaaaaagagagcggtaaaacacagggggtcagtaaacatgagaatagtggtggttagcaaaggattttattgtttttttatattttaattttttgtctgaatttcactctaaaacagagggttatttttgattcagaccacagatgagtgaataactatccccaaaacaccatcagatacggtgcatatatacccaagtgacttcgagatgcaggggggaactacctggttatctgactgcaatctcactgcagttgaggataaatggcttatggaatatggcagccatagccttcatgcaggcgagtggcgtaaaaaagccgggaataatcccggcataataaatacattcaaagaaccataattcacaataaaatgagggtaacaccttacattcaaattagaactgatacaccagaccaagtgctacaacgttatcagtattcaattttagtttattatcatcattgagttggtttattttataatcaacatacgtggacatgtttttgttgaagtaatatgttgcaccaatatcgacatatttaaccaggtcggtgtcaccaatgccttcgatatcttttcctttagattgaatataggcaatggaaggttttaaaccaaagtcaaataaatattgagccactaactcaatgttttgagttttattagcaaaaccacttacgctggttgacacgttattaattaccgcattaccagagattggtgtcatattgcgcgtttctgcataattggccgctaaataaacaccgttatcgctatatttcaggccggtagtccaggcatcggctttatcgcctttaccaaaggtactgttcttctgggctagggtgcggttagatgaagcataggctgcacctacgctgacacctgcgccaatctcatagctggaagataaaccgaaaccgtcgccattctgcttggatgtatcagcacgcccgttattcgtctcgccttcggcaccgttcttgccttgatattgcagagagaatttcagaccatcaaccaaaccaaagaaatctgtgttgcggtaggtagcaacgcccgtggtacggccagtcataaaattatcggttctggtgtagctgtcattcccgaactcaggcagcatatcggtccaggctgcaatatcatataacacgccgtagttacggccatagtcgattgaacctaaattaccgtaacgtaaaccggcaaaggctaagcgtgttttattgtcttttgcttcttggctctcggcatagttagccgcgaagttatattcccactggccgtaaccgctcagttcatccgttatttgagtgacacctttgaaaccaaggcgaacatacgatttatcaccatcactttttgtattatcagaaaagtaatgtaacgcttttacttttccatataaatccagcttattaccgtctttgttgtaaatttctgccgcatgtgaagtggttgcaactaataatgtcggtataaggattgccagaatattacgtttcatgttttgccctgtttctcttattgaaaaaacgcgaataataaaatttttgctgtattcaatatctgtctgaattttcccagcgcagaatttttaccgcatctgtgtgatatatttatgacaaattataaataactgctttattacgtaaattttatcctactttggttaacaccaagctggtgttttagcgcgagcgaaagcgctttcgggctgacgcaggcggcgctctgtgggacaatagggcatcattcagtttagataagatatgcatggcgttgtcttcagcagtaaaagaacaaatcagtcaatggtataaggcgttgcaacagcagatcccggattttatttcccgggcgccacagcgtcagatgattgctgaagtggcgaaaacactgtcgggcgatgctggccgtcatttggctattgaagcaccaacgggtgtgggtaaaacgctgtcttatctgatccccggtatcgccgtcagccgtgcagaaaataagccgttagtagtcagcaccgcgaatgtggcgttacaggatcagatttacagcaaagatttaccgctgttgaaaaaaatcattcctgacctgaaatttaccggagcctttgggcgtgggcgttatgtctgtccgcgtaacctggctgcaatgtgcactgatgtgtccgggcagggcgatttatcgctatttcttggtgatgaactggcaccggcaaacggtgaagagcaagcgacctgtctggcattgtctaagtcgctgaacagctacgtttgggatgggttacgcgatcaccatcaattggctctcagtgacagtttatgggccaaattgagtaccgataaagccaattgtttggggcgtaattgccattatttccgtgaatgtccgttctttattgcccgtaaagagatcgaaagcgccgatgtcgtggtggctaaccacgcattagtgatggccgcattggaaactgaatctgttttgcccaatcccaaagagctattactggtcttggatgagggccatcatttaccggatgtcgcacgtgatgcattagaaattgaaggtgaaatcacagcggtatttgccaatatgcagttggatatgattgttcggttggtggatcaatgcctggtgcaataccggccaaaaaatccccctgggctcgcccatcctgaacgccttaaagatcactgcgagcaactgcgcgaactgatgctcagtgttgaacagcaagtgagtcagttgctgcctactgaaggcaatcccgctgtgtaccgttttgagatgggcgatctaccagaaagtttaacggaaagttgtgccaaattattcaagctgacggatgcgttgcgcggggtggctgagtttgtactcaatgatttgagtgaacagaccggtaagcacgatatcgttcgtttacatcgcgcgatgatacaaatgagccggacgctgggttatctggaggcaatgagcaagctttggcggttggcggcgatggaaaaagcatcgaatgcgccgatttctaaatgggtgacccgcgaataccgtgacaatcaaacgcatatttactttcactgtgtcgggatccgcgtcagtgatcagttagataaaatgttatggcgcaaagtgccccatgtgattgtgacctcggcaaccttacgctcactgaacagttttgcacgtttacaggagatgagcggcttgagtgagaaggccggtgatcggtttgaaacattgtcatcgccgtttaatcatattgagcaggggaaattgattatccctaaaatgcgctttgaacccaccatggcgaatgaagcagagcatctggcagaaatggcacaattcttccgtgctcagcacgccagtgggcggcataaggggatgttgatcctgttcagtagccatcgggcgatgcaaacattcctaagtcacgtcaccgatctgcgcctcatgttactggttcagggggatcaaccgcgttatcggctagtcgaagagcatcgtaaacgggtgaataatggcactgccagtgtattgattggtctgcaatcatttgctgaagggctagatttaaagggtgaattactgactcaagtccatatccataaaattgcgtttccaccgatcgacagcccggtgatcctcactgagggagagtggttaaaatcactgaagcgctatccgttcgaagtacaaagtctacccagcgcttcattcaacttgattcagcaagtcgggcggttgatccgcagtaatgaatgtcggggtgaaattgtgatttatgatcggcgtttattgaccaaagggtatggtgcacggttgttagcggcattgcctgttttcccgattgaacaaccggatatgcctgaggggccgttggtgacacctacagcggtgaaagggcctgctaagcggacgaaacgggttaggaagacacgggataagccataaaaatacacctccaaatgtcagggggttatccaacatttggggtgcagttcaaaggggctgatcgggtttaattcaggccaagtgcttttttcacaccggcgccataagccgggtcaacctgcgtaaacaacgctatctggcggcgttggatagcttcaggaacttgcgataactcacccgcaatacgggtgaacatgcgttgatgctcttcttcactgagcaggttaaacagcgcccgtggttgagagaaatagtcggtgtcttcgcggtgattccaatgatctgccgccccttccaatgtcagtggcggttcgctgaaatcaggctgttcttggaacaggccaaagctgtttggctcataggttgcgccattaccactgttaccatcaacgcgcattgcgccgtcacgatgataattatggaacggacatttagcactgttcaccgggatctgatgatggttaacccctaaacgatagcgggcggcatcaccgtatgagaacaggcggccttgtaacatgcggtctggggagaaactgatcccagggacaacgttagctggattgaatgaggattgttccacttcagcgaagtagttttccgggttgcgattcaattcgaagtagccgacatcgatcagcgggtaatcaccgtgcggccagactttagtcagatcaaatgggttataaggtgtttgtgatgcttcgtgctccggcattacctgaatctgtagtttccaacgcgggaagtcaccgcgctcaatcgcttcatacagatcacgctgcgagctttctctatcagaaccaatcagtttttcggcttcatcgtccatcaggttttcaatgccttgctggcaacggaaatggaatttaacccaaaaacgttcattattggcattgattaggctaaaggtatggctaccgaaaccgtgcatatgacggtaagattttggcaagccacggtcactgaaatcgatggttaactgatgcagcgcctctggcagttgagagaagaaatcccatttataaaccgggttacgcaggttggtacgagggtcgcgtttgaccacgtggttcaggtccgggaacttcagtggatcacgtaaatagaagaccggtgtatcgttaccaaccaaatcccagttgccttcctcggtataaaacttcatggcaaaaccacggatatcacgttcagcatctgcagcaccgcgttcaccggccacagtggagaagcggacaaacatgtctgtttttttaccgatctctgagaaaatttttgcgcgagtatattgggtaatatcatgagtcacggtgaacgtaccgtatgcaccggagcctttagcatgcatgcggcgctcagggatcacttcacggtcaaaatgggctaatttttccaggaaccaaacatcttgcagcagcatcgggccacggcggccagccgtaataacattattattatcgacaacgggagcgcctgccgcggtggttaatcctttcttcttgctcatcatgttctccagtatggctgttgaattgattgcggttttgggtttaagcgtgatatcgcgtcaaaaacgtgattgacaagataataattttaacaaaaacacggtgttattctttgatctccccactagttgtagtcgtattgaccgcattcagcaaataggtatgccttattgttaacatgggtaatcgctattgctgtgggaactgacgatcatttgaaattatgatcatttgaaatactgtgctgtttaattagtttatccgtgtggtcttaggtttttttcgggtaaactccgcacaggaaaaaccataagcctaaaatggctaattggtgacataacgaacaatgagagagcaatatgaataagcatttagtggcgtgtgcagccagtctgctgttggtagccggttctgccagtgcggtgagttttaacgctgaaactgggcgtcattacaccaatttaggttttggtctggggacaaacacgggcggtttggccattagtggcaactgggcgcgcagtgatcatgacggcgatgtgctggggcttgggctggggtttaatttaccggttgggccaatgaccgcgacagtgggagccaaagggatttatatgtcaccagaagacggcagcagtggcggtgcggtggcgattggcggtgggctaagctatccgatcaacaaatcattcagcgtatacggtgaggggtatttcgcaccggaagagttgaccagcggtatgaaatcctacagcgaagccaatgggggggtgcgttggaacgtattccgcccgttaacggttgatgtcggttaccgctatatcaatatggaaggtaaagaaggccgtcgagataatcgtctcgctgatggggtgtatatcggcgctggtctgaacttctgattacccttttttatctgacgttagagcgttgtgcttataattgcagcgttgttcttataaataaacgttagcggtattcacttaccctcattactgacgtgagtcagtttatcgggcctcgttcacttgctgcccggcggcaacgctaatggctttgggttaacggaaatgacgttgggctgacggaaaagggcgcattcctatcaggatatgcgcccttattattgcttacgtatcaccctaccgcaggtaatgcgccagtgacaataccaatctgaataccaatcacggtaacaccacaggcaaacacgattgccagcgcgggtctcccaccccaaacctgatatttgccctgatgaagtttacgggctttccacgctaacattgcaggcagaattaatgccaatactgacaatgccacagcggcaaaacccaacgccataataaagccacgcggataaaacagcgcaaacagtaatggcggcgtaaaggtaattaaccccgtttgtaaacgaccacgtatggaatttcggcgtttaaataaatcagccaaatagtcaaatagccctaatgctacccccaggaatgaggttgccagtgccagatcagcaaacaaatgcaccgccagttcgacatggggagaggccacgacgtcgcgcacagcctggagtaaaccgttcaaacccgcttgctgggccagaataccgacaaaagtatgagaggaaatcgcccccagtgtcgctaattgccagaagatataagcgataagcggtatcgcactgccgatgataaatacccagcgcagtttacggatattaccgcccatataattaacaatgctgggtacgctgccgtggaaaccgaatgacgtaaaaattaccgggatcgcagagagtgctagcccttgctctagcggcaatgtcagtaggttggttttttcgatatgcggcatcatcagtgccagcattacgatcaggaaaatgattttggcactgaacaggatacgattgaacaaatcgaccgaatgggtaccgatgcaaaccactcctccggcgactagggtaaacagtaaaacgccgagataggtcgggaatgattgctgagtccattggctgatactggttgccaataactcgccagcaccactgatataagccgcagtaagcgcatacatcagaaacatcatactaaaacccgtcagccattgaccatggccaccgaggtaacgtttggctaatgtaccaagcccggtatcagccgcttcatattgataaacttccaccagcaataatgcggtgtaacacattaataaccaaagagaaacaagcaaggccagtgtgacgccaaaccctacgccggccgccgccagtggcatggccaacatgcccgcaccaatggtggtacctgcaacgataaatatactgcccagagtgcgattcttcacgctttcctctactactatggctatttataccccaactcaatggcatcacggtcagcatttatactcgcccgccgggtgaacctcaaatggggctcatttaatcctgatgagcagattcatgcggtaattcggttaaattaaagccgttaacaccgctgcaacgtcaaataagaggggtatattggaattattgaggcagaagagtagtggattggcctgtttgtgtcaaatcgtcgttacgatgagtgtaaattatagtttacgataataaaatcaataaaatagcgacagccctatcttgttgcgatctatccccaaaataattcgagtttcaggaaggtggcaactgaggggcaaattaatcgggaccccatttgaacagcatttatgctgcccgtagggtgagttgcggggatgaggcgcattaatcccctgaagtttatttattttaaggtcaacaacaggtaagtgactggggtgaacaaaggcagtcagcgtacaggcaacgtgcagtatgacgggcatacatagtgcagtgatccaaatagcacagagaaatgattgtatttaggtgacgtcattcttaaagtgacgcagtgagcataaacggagaagaaaatgatcagagtcgagatgttgagtaccggagatgaagtgctgcatgggcagattattgataccaatgctgcctggctggctgattatttctttaatcagggtttgccaatcagcagccgggaaaccgtcggcgatgatatttcggcccttattgaggtgttgactgagcgcagtcaagttgctgatgtgttgattgtcaatggtggcctggggccgaccagtgatgatttgagcgccttggctgccgcacgagctgcgggtgtggaactgattgagcacctggaatggattgctcgcatggaagcgttctttatagcgcgtggccgcgtgatgtcggcaactaatcgtaagcaggcccatattccggccaatgctgaaatgctggacaaccccgtgggcacggcatgtggctttgttctgcggctaaataagtgcctgatgtttttcaccccgggggtgccatctgaatttaaagtgatggttgaacagcagattatgccgcgtctacggcagcattttgaggtggctgaaccgccattatgtttacggatgaccacttttggtcgttcagagagtgatctggcgctggagctggatccgttaccactacctgaaggcgtggtgctgggttaccgttcatcggccccaatcattgagttgaaactcaccggcccagcgtcacaacgctcggcaatggagcaagtctggcagcaggtgagggcggtggcaggcgaaagcacgcttttcgaaggtactcagggcttgccagcactcttaaccgaacaattgacacagcgtggcttattgctggcggtgagtgagcaatttaccgctgggctgatgaactggcagttacagagtgcgggagcaccactggtcggcggtgagttgttacccgcgcattgccaggagtcgctgagtgaggtggctagccgcgcacagtcattgtctacgctgtgtggtgcacaggtcgtgttggctatcagtgcgatgcaacatgattgtctgagtgtggcattacataccccagaaaggacttttgctcagacagtgcgctatcaggcgagtcgccatggtttgcgtatccgtcaggaaagcagcgcgatgttggcacaggatatgttacgccgctggctaaagggcggctcagtgtgcgggcagcatggttggttggatattattgagattttgtaattaaaagagaatgttaatatttagcccaggcgcggaatagcgcctggttaatgagtgctatttgacctgcgcacttctgatatcttcgcccgcttcccagatccggtatttgacttccaccccttgcggtacatagaccacaatgggtaggcggctgttgtaacgctgcattgccgcgtcgcccaaattggcggtaacaaatttcacttgcggtttactgtcttcagggcaagccatcatggttgaggcgggttgtgagattttatccatcaccagataatcgaatccccaaccagataatgttctggtttccagattgccgccgagcatgtggcggttacagtcaacgttgagagttttaccgatcagcagctcaactttaaagcggctttcatctttttgaggctcaagaaaaatgacctgtcggctcatccctttttcagcttgtggataaggtgcgattttttctaatggctgctgctgattgagaggcgtaggcgtatcagcaatggcattgattgatgtcgctagtaatacactggctaatatgattgagcattttttcatctttttttctctaagttttatcagcaatacgtctctaaaactcgatttcaatgttgcccttgggttgacaacaacagggtaggatctctccggcctgtataaaagcgagtggctgctgcaaataacagacttcgcctttcagtaaacgcatgcggcaagagccgcaataacctgaacgacactgatattcaaccggcacttgatggtactccagcgtttccagcaaattgcggctgctggccggaacactaagctgagcaccggtggtatttaaggttacaatcgctttcacagattacagctcgaaatcactcaggtcgtcagcactgacttctgaatcaatttgacccaccagataggaactgacttccacttcttgtggcgcgacctggacgttatcggaaactaaccaagaattgatccatgggatagggttggtgcgggtgctaaagggtatgcccagaccgaccgcctgcatacggatgtttgtaatatattctacgtattggcacaggatctctttattgaggccgatcattgagccatcacggaacaggtattcagcccactctttctcttgctgtgccgccagtacaaacagatcgtagcattgctgttggcactcttcggcaatttctgccatttccggatcatcctcacccaaacgcatcaggttgagaatatgctgtgtacccgtcaaatgcagcgcttcatcgcgggcaatcattttgataatttttgcgttgccttccatcagttcacgttcggcaaaagcgaaagaacaggcaaaactgacatagaaacgaatggcttctaaggcattaacgctcattaggcacagatagagctgttttttcaaatcacgcaattttactaccacggtcttaccattaacctggtgggtaccttcccccagcagatggtaataactggtcatctcaatcaaatcatcgtaataagcggagatatctttggcgcgtttaaggatctcttcgttggtcacgatatcatcaaaaacaactgatgggtcgttaacgatattgcggatgatatgcgtgtaagagcgtgagtggatagtctctgagaacgaccaggtttccacccaggtttccagctcaggaattgagatcaacggcaacagcgccacgttagggctacggccttgaatggagtccagcaaggtttggtatttcaggttgctgataaaaatgtgtttttcgtgatcgggtaacgcgttgtaatcgatacgatcgcgtgatacgtcgatctcttcaggacgccagaagaaagagagctgtttttcaatcagtttttcgaaaatcgcgtgtttttgttggtcgaaacgtgccacgttgacggattggccgaagaacatgggttcgagcaactgattatttttattttgtgaaaaagtggtataggccatggtttcctcaggggtcgtgcaaaggacaaatagcgtaatgggcaaataggtcgcgtaacggacaaataaaaaaggctcattgacggcagtagcgtcagagtgagctacccccagcgacccgtggcataaataacgccatcatggataaccgggggtaaaaactaaatcttacatgcaccgccttcgcagtcgtcatcacccggcaggcttgattgaatgtcttcttgcacatcatcagcgccgtcacgggtgttttgatagtaaagcgttttcacaccaaatttataggtggtcagcaaatctttcagcaactgcttcatcggtactttacctgatgggaagcgggttggatcataattggtgttcgccgatatcgcttgatcgacaaatttttgcatcaaaccaaccagttgcaggtagccgtcattattcggcatttcccacagcagctcgtaagcgcctttcaagcgttcatattcaggcacgacctgacgcagaataccatctttagaggctttgatgctgacgtaaccccgcggtggttcaataccgttggtcgcattggagatctgcgatgaggtctcggatggcatcaatgccgacaacgtggagttacgcaacccatgagtctgaatttctttacgcagtgtttcccaatcgtaatgtagaggttcattgctgatggcatccaaatctttcttataggtatcgatcggcaaaataccttgtgaatacgtggtttcgttaaaccacgggcaagcgccttgttcacgggccagagcgttagatgctttcaacaaatagtactgaatggcttcgaaagtccggtgtgtcaggttattagcactgccgtcagaataacgcacgccgttcttcgccagataataggcaaagttaatcaccccaatccccaaggtacggcggcccatggcaccacgttgtgctgctgcaatcgggtagtcctgataatccagcaaggcatccagtgcacgtactgccagtatggccagatcttctaaatcatcgaggctatcaatggcaccgaggttgaacgctgacaacgtacagagtgcaatttcgccattctcatcgttgatgtcattcagcggcttggtcggtaatgcaatttccaggcacaggttagactgacgcaccggggcaattttcggatcaaacgggctgtgcgtgttgcagtggtcaacgttttgaatatagatacggccagtagaagcacgctcttgcatcatcaaagagaatagctcaaccgctttcacccgttgcttacggatactgctgtcttgctcgtatttgacatacaggcgttcaaattcatcctgatcggcaaagaacgcatcatagagccccggtacatcagaagggctaaacaaggtgatatctccacctttcaacagacgctgatacatcagtttgttgatttgcacaccgtaatccatatgacggacacggttaccttcaacaccacggttgtttttcaggaccagtaggctctcgacttccagatgccacattgggtagaacaacgtggccgcgccgccacgaacaccgccctgtgagcaggatttaaccgccgtctggaagtgcttatagaatgggatgcaacccgtatggaatgcttcaccgccacgaattgggctacccaacgcgcggatacggcctgcattgataccgataccggcacgctgtgacacgtatttcacgatagcgctggaggtggcattaatagaatccaggctgtcaccacattcaatcagtacgcaagagctgaactggcgggtgggggtacgcacacccgccatgatcggtgttggcagtgaaattttaaacgtagagatagcgtcgtagaaacgcttgatgtaatccagacggctttcacgcgggtagccggagaacaggcaagctgaaaccagaatgtacaggaattgggcactttcatagatctcaccgcttacacggttctgcaccagatatttaccttccaactgcttaaccgcagcgtaggagaaattcatatcgcgccaatggtcgatgaaagtgtccatctgctcaaattcttctgcggtgtaatcttccagcagatgtttgtcatatttacccatttctaccattttcgacacatgagcgaaaagcgtagggggttcaaactgaccataggcttttttacgcaggtggaaaatggctaaacgggcagccagatattgataatccggggcatcacgggagatcaagtctgcggcggccttgataattgtttcatgaatgtcagaggttttgatgccatcataaaactgaatgtgtgaacgcaattctacttgtgataccgagacgttatgtaaaccttcggcggcccagtcgatgaccctgtggattttatccagattaatgcgttctttgctgccatcgcgtttagtaacaagtaggctttggttcatgtgctcttttacctttaatgtgtttatagcgcgtgagctaagggatcaacaggccgatttttcaaaccgcgagctgaattttcaagcactgacttgtgccatcgctcagtatacaaacacaatatatagtgggtgggtgttggacagataacaagatagtgagtattgaggcttttggcaagtgaacaaaacgggataattgtgtggataacttgggggttaattgttacgaatgccttataagctgcgccattactgggactcactacttatccttctgggggataagattttgcggaaaatcttaaaagtttgatcgtttgccgctttattaaacattctaaaagaaccctgtaatttatcgcttttattgctgaaaaaaacgctttctgcctgatctggcgattaacagcatataaagggataactgcgagggggaaaagccaggaagagcaggtgcttagccctgctcccagtgggttctacggctgatctattcgctgtcccgttgtgtatgcaccatataatttacatcaacattgcggccaagcttaaaatggtcggtgatcgggttgtaatgtagcccgataatatggcgttcaagcaatggcgtttgatctacccagcctattaactctgacgggcggataaactttttcgcatcatgtgtgcctttaggcaccattttcaatagatattcggcaccaacgacggccattagccaagacttggtattacggttaatggtcgaaaagaaaacatgcccacccggtttgaccaattgtgcacaggcccgtaccacggaagcaggatccggtacatgttcgagcatctccatgcaggtcactacatcgtagtgttgcgggtgttgctgcgcatgattttcaacggtttcctgcacatactcgagtttgacgccagtttccagagcatgcagacgcgcaacttgtagcggctcgtagcccatatccaggccagtcacttgcgcgccttcacgcgccatgctttcggccagaatcccgccaccacagccgacatccagcacttttttctcaaaaataccgcctgagcgctgcaagatatagttgaggcgcaggggattaatacggtggagaggcttaaattcgccttctaaatcccaccagcgggaggcaacagcttcaaatttagcgatttcttgctcatcaacgttatgatggcggcttgtcgttttggctcgcatgatgggttctcactgttttgtttctttgcgcggattatacatgttccccatcttttgtattagccttcgtgctcgacgttgccgagggcgtgagctgtggccatcatttgtggtgagagtccgtgctctggaggatagcgggtgagaatgatccgagagcgctgtcatttaaccaaaaacatatcattcaacccaaaacatgccgtttaacccaaaacatgcagtttcgccaaaatctgcgttttgtgatatagtttcgtacctttaaatccggtaatcagtagagggatagcggctcaatgagcgaccttgccagagaaataacaccggtcaacatcgaggaagagctgaaaagctcctatctggattatgcgatgtccgttattgtcgggcgtgcgttaccagatgtccgtgatggactgaaaccggtgcaccgtcgcgtactgtttgcgatgaatgtactgggtaatgactggaataaaccatacaaaaaatcggcccgtgtagtcggggacgttatcggtaaataccacccgcatggtgacagcgcggtctacgacactatcgtgcgtatggcccagccgttctcactgcgctatatgctggtggatgggcagggtaacttcggttccgtcgatggcgactccgctgcggcgatgcgttataccgaaatccgtatgtctaaaattgctcacgaattgttagcggatttagaaaaagataccgttgacttcgtgcctaactatgatggtacggaacaaattccggctgttatgccgaccagaatccctaacctgctggtaaacggttcgtcgggtattgcggtagggatggcaaccaatattccgccacataatctttctgaggttattgatggctgtctggcctatatagaagatgaaaacatcagcattgaagggctgatggagtatatccctggcccagacttcccaacagcagccattattaatggccgacgtggtattgaagaggcttatcgtactggtcgcggtaaggtctatatccgcgcacgtgctgaagtcgaagcggatgccaaaacgggccgtgaaaccattattgttcatgagatcccgtatcaggtgaacaaagcacggttgattgagaaaatcgccgagctggtaaaagaaaaacgtgtcgaaggcatcagcgcgttacgcgatgagtctgataaagacggcatgcgcatcgtgattgaaatcaaacgtgatgcggtcggggaagtggtgctgaataacctctactctctgacacaattgcaggtgactttcggtatcaatatggtggccttgtctcaggggcaaccgaagctgcttaacctgaaagacattctggttgcttttgttcgtcaccgtcgtgaagtggtgactcgccgtaccatttttgaactgcgtaaagcacgtgatcgcgcccatatccttgaagcgttggcgattgcactggctaacattgatccgattatcgaattgattcgccgtgcatcgacccctgcggaagcaaaagccggtttgattgccagtccttgggagttaggtaacgttgcttccatgctggaacgtgctggtgatgacgcggcccgccctgagtggctggaagcggaatttggtatccgtgacggtaaatattaccttaccgagcaacaggctcaggctattttggatctgcgtttgcagaaactgacaggtctggagcatgagaaactgctggatgagtataaagagctgctcaccttaattggcgagctgatctttattctagaaaatccggatcgcctgatggaggttatccgcgaagaattagtggcgatcaaagagcaatataacgatcttcgtcgcactgagatcaccgcgaatacctctgatatcaatattgaagacctgattaatcaagaagatgtggttgtgacgttgtcccatcagggctacgtcaaataccagccgttgagtgattacgaagctcagcgtcgtggtggtaaaggtaaatctgctgcacgtatcaaagaagaagactttattgatcgcctgctcgttgccaatacccacgataccatcttgtgcttctccagccgtggccgtctctattggatgaaggtctatcaactgccggaagccagccgtggggctcgtggccgtcccatcgtcaacttgttgccgcttgagccaaatgagcgtattaccgccattctgcctgtgcgcgaatatgaagaaggccgtcatgtctttatggctaccgccagcggtactgtgaagaaaacggcattgacggagttcagtcgcccacgtagcgccggtattatcgccgttaatttgaacgaaggtgatgagcttatcggtgtggatctgacggatggcagcaatgaagttatgctgttctcagcattgggtaaagtggttcgtttcccagaagggcaggttcgctctatgggccgtaccgcaaccggtgtccgtgggatcaacctcaatggcgatgatcgggttatttctctgatcattcctcgtggtgatggtgaaatcctgaccgtaactgaaaacggttatggtaagcgtactgcagtggcagaatatccaactaagtcccgtgcgactcagggggttatctccattaaagtcagtgagcgtaatggtaaggttgtcggtgctgttcaagttgcaccaactgaccaaatcatgatgatcactgatgctggcacactggtacgtactcgcgtatccgaagtgagtgtcgtagggcgtaatacccaaggtgtgaccctgatccgtaccgcagaagatgaacatgttgttggtttgcaacgtgtcgctgaacctgaagaggatgatgatatccttgatggcgaatcatcagaaggtgaagagggcagcgaagaaaacgcggcactaaatgcaccatcagatgatgttgccgatgaagacactgatgcagaagacgatactgatgcagaagacgagactgatgtagaagacgacaacgcataataatgttgctctggcaggtgcggtttattgcacctgctcattcatctgcggcgacccagtctttaggtgatcgtgtcattaaaaaacagccagccagtgagcttaacgcccatcagttaagcaactgagctggcttttttatcggttatcggtagtatattctgttgttaacacagcctgtctggcgatgctttttcatcatggtatccgattgaaatatctctcttcattccgtacgacactaaaaatatcccgctacttattccgggtattggccgttatgttatggtcgcttggcgcattattgaccactttttatatcctgaatgtacttaacgaaaaaaaagccgatattcgtcaggaatataacaacaactttggtttggcgcagaactacatccggcattccgctgaaattatacgcgatatcaaatatatggcggaaaatcggctagataaaaacgccagtgacactgatgccactagtggcatggttatgaataaaaaggcggtaccacaatattacccgcttaactcagattcaggttgcacgacggctagcacgtctaatcaagcgtcagtgaatactctcagtaaccttatttggtactggaaggagaactttactgccgcttatgatctcaatcgtgtcttttttattggcacggatacgttgtgtatggtggattttgacatccgtaatgctccatcgctgcaagaaaacctgcttaagtcgctgtatgagcataccttaaagtaccgtgataccaagaatcaggataaagacagcaatatttactgggtggtacctggtgctcgtcccgatattggcgtcttgtatgttctaagccccgtttatctaggtaatagattagaggctatgattggctttgagcagagtgtccgcttggaggattttatttcttcccgaacactgcctatcagagtgaccttattaaatcaggataatgaacccgtgttacagatggcatcaggtgatcgttatccggctatactggatgattatcctgattcaccatcttactttggttatgctgatgattataaagatcttattctaaagaaagctttaccaccatcccccctcagtattgcttattcattacccgtcaaaacgataatagaagcattcaaattattgattttcaatgcgttacttcttaatgtgctctctgccgtagtgatttttacattggcttggctatttgagcgaaaaatgtttcatccggctgaagataatgcgctgaggcttgaggagcacgagcaattcaaccgcaaaattgtggcctcggctcctgttgggatatccattttgcgtatcagtgatggtactaacatcctgagtaatgaattggcacataattatattagtttactgactaatgaagatcgggaacgtattacgcgcattatttgtgagcgtcaggctaactttgtcgatgtaatgaccagcaacaacaataatctgcaaattagctttgttcattcacgttatagaaatgaagatgtggcgatttgtgtgttggttgatgtcagtgctcgggtcaaaatggaggaatcgctacaagaaatggccacggcggcagagcaagccagtcaatcaaaatccatgtttctggctaccgttagtcatgaattgcgcacaccgctgtatggcattatcggtaacctcgatttattgcaaacgaaagaattaccgcagggagtcgatcggctggtaacggcaatgaataattcgtcggggttattattgaaaattatcagtgacatactcgatttttctaaaatagagtctgaacagctgaaaatcgagccaagcgagttttctactgtggaagtgattacccatatcacggctaactatttgccattggtcgtcaaaaaacggttaggactgtattgttttattgaaccggatgtcccacggctcatagaaggtgacccggttcgcctacaacaggtgatttctaatctcctgaataatgccattaaatttaccgatacaggctgcatcattttgcaggtacgcgtgcgtgattgctatctggagtttcgggtgcgggataccggtgtgggtattgattcacgtgaaattaatcaactatttgatcctttcttccaagtgggtaccggtgtccaacgccattttcagggaaccggattagggctggctatttgtgagaagttagtcaacctaatggatggcgatgtcgaagtcatatctgaattggggatggggagtatttttgctatccgtattcccttgtatcatcaccaaaataccgtcctgtccgccaatgatcgctggcaaggaaaagtgctgtggttagatattcgcaatgcacgcctggagagctatttactcgatctacttggctactttggtgcgacaattcggcgttactgtggtgagcagactcagccggaagatgtgctgatttgcgattatccgtcacaactcagcccccctttactggcatggatccaactctccattgaacatattggtttaccacaagagacgcgccctgcttactggtcactgagtacctcaactttactggagatagtccccttgctggactggatactgcggggccagcagccggttgataattcatcgttacagttacatgcaccgaaaacgaatcaagataataatgccgatctgcaaattctggttgtggatgaccatccgattaaccgccgtttactggcagatcagctcaccactttgggttatcgagtcattacggctaatgatggcttggatgcattggtggcgttaaatactaataccgtagatatggtattgaccgatgtgaacatgccaaatatggatggttaccgtttaactgagcgtttgcggcagttgaatcacaatttcccgattattggtgtaaccgcgaatgctttggctgagggaaaacaacgttgcattgaggcggggatggataattgcctgtcgaagcctgtgacgctggatactctgcgccagatgctgctttactacagtgaccaagtacggcgatcacgttagatttcattaattaataagcccagtattgcagagcaaaactgggcttgagagtcgagcggggcaaaaattacagttctttatccacttggctaatcgtcacagacgaaagataatttagcaaagcgatatcgttatcaacgcccagctttagcattgcagatttcttctggctgctaatggtcttgatactgcggttaagttttctggcaatttctgttaccagaaaaccttcagcaaagagtcgcaaaacttcactttcttttggtgacaaacgcttgtcaccgtaaccattggcactgattttttcgagtagtttggctacgctttcaggagtgaatttcttccctttttgtaatgcggccaatgccttaggtaagtcagcgggtgcgccctgtttcaatactattccgtcgatatctaagtccaagacagaacttaagatagccggattattattcatagttaagacaattatagccaaatctggataatgtcgttttatatatttgattaatgtgatgccatcaccatacttatcccctggcatagagaggtcagtaattagcacgttggcatcaagtttggacaaattgttaataagcgcagtggagtcttcaaattctccgacaacgtttacccattcaatttgctcaagcgactttcggatgccaaacaaaacaattggatggtcatcagcaataattacattaaggttgttcatggttatgggttaccttcctgcaacagtctggtgatgaaaaaatcaatctgactgatgctattttcgatcttcaaccgatcgccatctgcgatatgctgttctaatgtttcacatagctgcttgccgagaaccaggttcagcatggcaaatacgccttttaatcgatgtacggtttgcgaaagtgatgttaaatcactttgctgaagttcagtatacagtttcttcagatctaccggtactgtctcgacaaataaggaataatagtcactggtttttagttgcctctcatagaggtttatatcatcttctgtaatgtactcaaccttttgttgcgattgttcagataaaattcgccgctcgattaataataatattgaatcaataaccgcgctgcttaaattgtaatttgcccgtatataattgttttgtaactggtgaaaccccgtttcatccgccgcgagcaataatgtgtaattatcataatgttgcggattatccgttattgtaacatcataatcccgccctggtaggcgttcatcggtgagaatgcagttagcaccaaatgaatttaacaatattgtaatgatcgagcgtacttcttctgaggttatatctaatagtactgtgacaccatccagtaatttttcttgcgtgtcttgttgttcatttttaacggctattgttaaccggatagtatagcgtgtacctatatctactttactgcgaatctctaattggccgtttaattttttacataattggttacataaaaaaaatgtcagccccgaaccatgattgtatctgtcggccaatgcttggctaaggaaaggataattaagattacctatctcttcatcagaaatacccgcgccagtatccattatttgaataaccaattgttccggatgtcctggttcatgatctacattgagggtaatttttccgtaagctgtggtaacgatagaataattcagcaacaacgaaagtattttacgtaataccttttcatcacctagataaatttggtcaaggctgacatgaaaatgattaaacagatttaagcctttccgattaatcgaggggagcagatccagtagcaggttatcgattaaggttgataaagagaagacctgttgttctgtttgccaatcttgtgtttccagcttagtcagtaacgtaatgttatcaatcagttcaaggatagttgctgattgctcaaccagcttggtcttaatgtcatgctgttgttgcaaatcggtagtgtcctgtaatgtacgaacaagttgactcaggtggtggaccggttggccaagttcaatccccaggttgtgcaacatcagtttccgcgcttgtagatttttatcgtactcacgccttgcttgctgcaatttcttattcaccaagacttctttatcctgatcattaagtagaaaaagatacgtctctggtgagatctggctacggaacatgtggatttcataaacttcgttattaaccgtcccttgaatcacaccgtggtgctgctctgccatagtggcaattttttgtagattcaggtgaggcagtagattttccgctatcttgttgctggcaatgacagtgctgttgctgaagtcataaattaataagccttgcggtaggttggtaatgatctcctgactcaacaatctctgagcttctaattgtccggtcacatcagcacttggacgaccatattggtggcggacaaaataggcggccagaatggttagcgctaataacacaatattggctaggattaaccaaaagttgtttattaataagtcgataatcaaatgactaaccggtacacgataaataattttcagtgtgacatttgccagtggtgcggagaactcaacccatgagccgttcagtgacacgctggttgccgcaatatcttcgggggtagccccctcattgagtggcactttatctggttgaagcaggaagttcgaacgtgccatgttcggtggaattaaatcattgatcggtaaatcaaaggcgatcacggtggctaaatggccaggacggttaaaggtggttcttagcgtgaaatagtaggcattttggaagcgcaatttgcgtaagggcgagaagctctcccgctcatccaacgtattgacctgctgtagcatttccgcccgtcgcgattcagcaaaggcagtaaggtagctctctttaaagcgtgatgtgacctcttttagtgcctgagtcgtaatcaggagtaagctattgtcctgcccgttaagatagtacatcgagtaagtgtcattttgcggcccccacaggttatcaagatagtcagatatctgtaatgccatggtcagcgttgcaggctcgtggttaccaaaaatgatagcgtcagtctttctgcgaggcttttcaatatagtaaacgtcagggcgcaggcgggtttcctgcaccacaggagggggctcacttgctttgatcggattattgactaaatcatatatttggtaagtatgatatcgatagtcatcaatgcgttgttgcaaaccgttagcgatattcgttaaagcatgcttcttttcagtcagataagcattggtatagttataggcatatagcccaacagtcatgagcagaagtacgataaatagccagaagtaacgtgtaatgttagccgctgagtgggtagacgaattgttttgcataacgataatgccgattcccttggttagcgcgtgacggctctggcgctggcagcaacggttaataacagaagtgctacacagccaaaagcaaccgatagactacttaattgtgcaataaagccgatagctgccgggccagccaaaattcccgcgtaaccgatcgttgtaattgacgcaaccgccaggttggcaggcataacggtttgattacctgcggcggtaaacaagatcggtaccacattcgatgcgccgaaacccactaacatgaagccaataatagcagccattgagctatcaatactgattgcgataataatcccgatggcagaacataaactgccacctaataagaccttgtaacggcccagcccattgacaatccgatcaccgtttaggcggccaagtgtcatagcgatggcgaatacggcgtagcccatacctgcttgtgatggcgacatgccgcgtagcgtcgtcaggaagacggcactccagtcaagcatcgagccttctgccaaaaacatgacaaaacataaaaagccgatgaacatcacccagccacggggaaaaacaaacaatggcccatcatggggttcaccgctgccacgtaacagattcttattggctgccagcagcaaaataatcatgagtactacggtagccataatcgctgtcagtgggttgaggcctagccacaatagagcactgacacctcctgcaccaacaatcccaccgacactgaataaaccgtggaagccagacatcatcgcccggccactggctttttcaacaatgacagcctgaatgttcatcgccacatctattatgcccatagctgcaccgaatactaatagtgcgatagccatcgtcgcgggagtattcatcaatacgagtaaaggcaaatctaaacagagcactgcgcctgccagtaaaatgacggcccgacagccccacttcgcggtaagcacgccagtgagcggcatcgccagcatcgatccaataccaatgcataacagtaataaacccaatgaggcatcattaagaccaatgcgcgcttttgcaaagggaacaagtggtgcccaagcggccatgcctaacccggcaataaaaaaagctaaccgggtagaaacttgttggctaataccgggctgtactgcttgttggtgtattttggtgctcatgaggtatcagatctactattgaagtgaaaaagtgatatagacagacgtttctatcacaaagctaaatccgggtcgaagtgatttgtgctgataagcagaatacttaacagctaccttttaaaatagtgcctcagacttgatacaaacccgccagattgtatggattagaatgtaaatttctctgattttctgatgtgatcgcccccgtggtgagtgagcctggtgtgaaaatgtacggctgtcagtaaaccaataaaacagtttgggatgacttaataacgtggctgagtggagcagggggattattatcaaatactttcttttttgggatgactacttttcactcggcaagagtcagttatttgggcacgagaattgaccagatgacattaagctatttgtacttaagtaagtttatgggggaaagataagtacaagtgcttttatatataccctatataattcgagtcgcaggaaggcagtaagagagatacaaatcggccgggaacccatttgaacagcatttatattacccgtaggatgagcctcagagatgagactcattaatctcgatgagtttacttaattttttaagagcaatatcagtaagtgattcggtttattgaacgtagaaaatgcatattcaacttgaagtatgacgggtataacgaccgcaagtggatatctttggaccggagaaaaaaaccggtcagagaccggtcgtaacattaacgaactatctgactgtgttagccacaatgataggaaaataatgatgatagcgtggctattatatatccctgttgatgtgtttatattgtcaatttgtgctaatcatatgtgctataactcactgtttacaattgctattatatttaaaacgattgttatcaacattaaccaatgatttatttttttataaatacttgttgcaatttacatttttaaatatttcttatgtatatgaaacattgttcttaatttggtggcattttctatatggattaatggttgtattattattacaatatagttacctcgtaggcagtatattctcgaaagagtagtggtatagatatatctaataatagaggatgataacaatgaaacttcgagttctttcattcattattccggccttattggttgcaggcagtgcaagtgctgcggaaatatacaataaagacggtaataaactggatttatacggtaaaattaacgggttacattatttttccgataacaagaaccttgatggtgaccaatcttacatgcgttttggcctgaaaggcgaaacacaaatcactgaccaactgactggttatggtcagtgggaatatcaggtcaatctgaataaagcagagaatgaggacgggaaccacgacagtttcacccgtgtaggttttgcgggtctgaaatttgctgactacggttcattagattatggccgtaactacggtgtcctgtacgatgtcacttcatggactgacgttctgccagaatttggtggtgatacttacggtgctgataacttcctgtcacaacgcggtaacgggatgctgacttaccgtaacaccaatttcttcggcttggttgatggcctgaactttgctctgcaatatcagggtaaaaatggcagcagtagtgaaaccaacaatggtcgcggtgtagcagatcaaaacggtgatggctacgggatgtccttgtcttatgacctgggttggggggtgagtgcatcagcagcgatggcgagttctctgcgtaccactgcgcaaaatgacctgcagtatggccagggtaagcgtgccaatgcctacaccggtggtctgaaatatgatgcgaacaacgtttatctggccgctaactatactcagacttacaacctgactcgtttcggtgatttcagcaatagatcaagtgatgccgctttcggttttgcagataaagcacacaacattgaagtcgttgctcaataccagttcgattttggtctacgtccatcagtggcttacctgcaatccaaaggtaaagacattgggatctatggcgatcaagatctgctgaaatatgttgatattggtgcgacttacttcttcaacaaaaacatgtccacctatgtggattacaaaatcaacttgttggataaaaacgatttcaccaaaaatgcccgcataaatactgatgatattgtcgcagtaggtatggtctatcagttctaattctgattataggcgtgagtcctgagagaaacgcggtcattcggccgcgtttcttattgtgagctacggtggatctcatcgtaatcacctggtggcaagtatcgtcttgcctttggtgccgcgccattcattttttatattgatgagtcagtctgttcaagtttctccggtaatagttcccccagcgttgttctaatactgatagcagctctggtaccgataaaagtacaactacgatgtaatctgaataggggaatttttagctgagttgactttttttaaccaattttggcatgaagtttaaccaaacaaattaaatttctcttttttttaaatgaaacactagacatatcatcgcgctatagatgataatgccgcccattggaaggatggccgagtggtttaaggcaacggtcttgaaaaccgtcgactgtaacaggtcctagagttcgaatctctatccttccgccaatttcgccggcatagctcagttggtagagcaactgacttgtaatcagtaggtcccgagttcgactcttggtgccggcaccaattaaaaacccgttatctgaataagataacgggtttttgcttttctcttaccttcacttcacatctaccgcttatccagcatgtgcccggtgcgggctattgctctcattacggggtatgcagtcaacaacggtcagttcaggccgatagagattggcggcagtatttaccctgccgccgtgctacatcaatgatttttcaccaactcagcaaccaattgattcacaccatcactcatattgctgaatttagtcagttggcttcgtgtgaccaccacaaaaacgccaatgtttttttctgggaccatcgccatataagtaataaatccaccgccaccgccggttttttgcataatgcccggtaagtcagctttgggtgccatataaacccagcctaagcccagagcatcagcttgaccggcgacatccatacctttcaatgacaccaagtcaccgcgctggaagtaaagcgcttgctcacgtttggcggaacgcttgggggcgctgttatcagaagctaagaattgttgcatccagtgctgcatatcttcgggggtcgagtaaatgccgccactacctgctgctgcaactgtattcccacaacgactgctgccaacacctatcatcaggcgtttacattgctccgccgtcggggtcagggtggtatttttcatccccagtggtgcggtgattttatcacgtaataagtgggcatacggtttccccgcagctcgtgacagtgcgtcagccagtaagtcgtaagctaaattagagtaagcggctttcacgcctggtggaacggtcactttggccagtttcaaccattgccagcgattatctttggtcggccaggtaaacaccggtcttttttgcgggccgccgggttgctcacgggggaggccgctggtatggctggccagatgcaacagcctaataggttgcttagcactgtaagagggaacgttgacccctttcggtgcatatttttttaacgggtcagttaacttaacgatgccatcatcagccagttttaccatgatttcgctggtcattagcttggttattgatgcaatgcggatcagtgagtctggccgtgggcgaatattgttgccgggttgcgtttcaccaaagctacggttgacgacctgattgttatcgataaccaccagagccattcctacagctccactgttatagaagatatgttcggcgtattggtcaacaatttgcgaggtcaacagcttagtatcttgcgaggtcaacggctgagtatcggcatggctgtgcaacggaatagtccacaaagcagcagccagcagcggggcagagagacgtttcaacaatcttttatccatgtttaaaaggcaaaataagtgatcgtgcgcttatagtaatcggatatttacataatacatgctgaaattttcaatcagatgaataatttacattacaaggacgtattgactggaagaatgccaaatgcgttgaaacaggtcaataaagacattgagattattgtcgctgacattcaacgccgatattttatctacccattcatgttcagggaagggagaagcaaaaaccgcactggcgggaccggtgcggtttgtggtcacgaccagaaattaattaactttcagtaaccggtttgggtatgacggttggtgactctttgacgcccagggggttattgccccaacattgttcatatttccaccccgtcagttcttccgcgacggctctggcatgagcggggatatctgccatggcaccgccatttttaatacgctcaatttcttccagtaaaatgctgtgatttttgcgatccagtttcatctgtgtggtgtagtaaatagcaactaatgccagtgagataacccctatggcaaagacacccacgatggcttgcacagcaatttctggctgactggattgaccagaaacaaaaccaaagcggcttaacgtccagcccatggcaaagacaataatcgaacgtaccattttcccggcgaatgtcatcgcgccagcataaattccttcacggcgacgcccggtcaagacttcgtctacatcggccaggaaggtataaactgtccatggaatatagtagatcccaccagtacttaaaccgaaaacagcggtaatgcagaataagacgataacggtcgtggtttcagaccaaccggtgaaatacagtgctgcgtaggcaatcacgctgacaatcaccacttgcagagcaatacggaagggacgagcgaaacccatttttacgcagatgccaataaaaatagcggtggagatgagctgcataatcgaactgaagctattgagctgcgaaaccaatgcggcatcttgtcccaagccaaaaataataaagtaggtaaatgcggatgcgaacaaccattcagcaccaaaaccgaacagatacatccccagatgcttgcggaaaatgcgcagatggaaggtcgatgccatatcaacacacagctttttcagtgcctgacctaaactactggtggtttccctgaccacttcactggctggacgctcccatgatgagctgtaaagccaaatcatggcgcagcacataatcagaccataagcgataccggtatataagaagggggttgcggaatctttgccataaattgcaatgaattgacctggaatgaaagcggccaggaagttcgctactttgccgaagattgctttagaacctgtcagtttagagcgtttggcaaaatcggttgtcatctcggtagccagtgtttcataaggcaccatgatggaggtgtaaattaattcaaacagcgcataggtcagtaggtaataccagaaaccaaaaccactcatccacagcattggatagaccaacacgagtgggatacccagtaagataaagaagcgacgacgcccgaagatacggcccaaacgggtattgtagaagttatccgtgatataacccattaccgggttactgatggcatcaataatactggcgattgaaaagatagtggctgcttctacaacagaaagtccgcaaaacgttgtgtagaagtacatcagccaggcaccactaatggcgagtgccccactgcccagcaagttagcactcccgtaagccaacgtatgccttgttgaaatctgtttactcatgtttaccgccacctcaaattaaaacaatgtttcatttataatgaataactgttttctttatagcggtatagcgtttataaaaatgagttggagatcacgaaaaagatttttacgacgtagaaagccatgtatatcaataaaaattgatatacatcaattgagaggaagacgcatttattccgtaataagacagaatgtccacaggagcatggatgcgtgataatgccctcttaccaccataatgactgtgacaatagtggcaatattgatattaatcgtatgaaataccatcactgatccgggggttattgtttaccctgtgagaaggatcacctttgttctcatgtgatgtgttacagaaaatcccaattaatgtatgttggctgcaacagcggttggcagtaaaggacgtaaaatggcgaagaaaaacccctattatgatgccagcaagccacatcacacagagtttggatttcagaatatagaaccggttgttcatcatccgcaggatttgaaacgctggcgtgaagagagaaagcgccagtcgctgcctaagccgcctcaacagggctacccgcagttcgttacagattggtggcaacaagctgacttttcagggcagcaagatgcgttgtggtggcttggccatgcttcattattgttacgtatcagtgggcaggcggtgttgtttgaccctgtgctttcaagccgggtttcaccggttaatttttatggcccacagcgcaaaacaccaatacccgccagcgtacagcaactgcccgatattgatgtgatcgtgatctctcataatcattacgatcacttggatgtcacgactatcacgcaattattgcgccgtttccctgacgtggtgtttttggtcccattagggctgaaaaactggttgcggcagcatggtgctcgccatgttcatgagttggattggtgggatcaacggctcgtcgctgactttgagttccattgtgtgcccgcccgtcattggagtatgcgcactccttgggatcggaatcacagtttgtggtctggctgggtagtgaagcggggcgaagttaacttttatttcagtggtgatactggctattgccagcaattactggatatcggtgaggcactggggccattcaattatgcggcactgccaattggtgcttatgcaccacgctggtttatgcaggcgcaacatatggatccacaacaatcggtgcaattgtttcaaaaattacaccaaccggtgacgatcccgattcattggggggtctttgaactggctgatgagccattggatgaaccaccagaacaacttcaacaggcgttaaccgatgccggagtggcgcacaataaattcgtaccaattaaaataggtgcacggatcatactggaatagtcacgttccagcgggtggatgaataacctgctggaactgaatgacggcggttctggttgatagcagcagcgcgttagatcttaaattgattaacggtatcagttaaatcagcggcctgagcttgtaaggcggctgaagcggccgttgactcctgcaccagtgcggcattctgttgcaccattgtatctaattgcgctactgcactatttatttcgtgaataccacgcatttgttcatcagcggcattggtgatctccgacataatggtcgtgacatcagagacactactgacaatatcggtcatggcattactggcttggcgcacttggctggagccggatgccacactgctgaccgtcgattcgatcagggcttttatctctttagccgcttgtgcactgcgttgtgccagtatacggacttcgcctgcaaccacggcaaaacctcgtccttgttctcctgctcgagcggcctcgacggcagcattcagtgccagaatatttgtttggaaagcaatgccatcaatgacgctagtgatatcgccaatttttcccgaggccttttcaattgactccatcgttgtgatgactttagtgataacgtcgccaccgcgagaagcatcctcagaggcagaaaataccgcgttgttagcttgccgtgcggcactggctgattgagcgacggttgccgaaatttgttccagcgctgctgaggtttgctgcaaactggcggcggctgattctgttctacccgataagtcttggttgcctgctgcgatttcattcgcggctacccggacagactcgctggtaccacggatttgagccataaccagactgagcttatccgcaaactgattaaatgaacgggcaatctgtgctacttcatcacggccttcgatcgggaggcgttgagtgaggtctgccgagccggaactgatagcatccatcgcttgctgaatatgtgttaatggtgtcagggcgcgttgggtgatcagcgctatcacccccgccgagatgaagataattatcaccaatgttactaatgatgtcgttaataatgaatgtattcccgcagttgcttgagatttatccagcgcaacgacggtaaaccactgggttccagggaccgcctgggcgagcaataatttgctgctgccgctaatatccgttgaaacaggtaccgttgccgtcagcagggtttgtaaattcaggttcggcgcgatatcggccaatggcttaagggtcagcagcgtctcaggatgggcgatgattgtgccatcagccccgattagcattccgaagctattatcggttgggtgtatagcatttacattggcaatgacacttcccatagtgacatcggcagcgatcacgcctttaagaaccccatcctgaacgatggaccatgcaaatgtgacgactaactgctgggtccccgcatcgatatacggaggtgtcaccactggcttgcctgcattcacggcttgtagataccacgggcgtccggtggggtcataatcggcaggaatgccatccgggttggaaaaaatagccgttttatcggcatagccaatatagacattaataaagccgcctgctgcagccacttgctttagtgctgcgagtggatcggcggtcaatgcgctgtctttgagcgacataatcatttgtgttttggatgccacccattcagcaatgctgacactgtggctaacagtgagtgccgtcagggtattatcgatggcactgttattatatttattggcaacggaatagttgaggaaggtgttaatggcgagcgaacccgcaacgatgataatacaggctgccaaaatacgtgagcgaatggaatcaagcatagagtgtcctaatagaaaggaaaacatgattcaagtaacggcttggcaggaaaaaacttgagctgagtcacagtaataaactgtaattaatgactactgttaattattgctcatgtgtacatggtgctttttagtcatgattatgttttttattttcataaaaaacagggtgttgttggtttttgttgaaagcattaagatgcaaaaacaggagtaaagtttaaaaaaatagtaatgtttattgcgtaaatgagtgcctatcagtttaccaatggggtacatatatagctgagctgtgtgcagatgtactgtgtgcagatgtattgtgtacagatcgattgtgtacagatcaattgtacacaacccctgattttcgatttccggcgcttattgtgtttttatgcgattaaaatttgtactgaaaacccacggtaagggtttggctttgatactcaatacctgatttactactgccaacattcccggtggcgtagttgagcgtttgtgtctctcctcgcccttcagaatattggttccaagcggcttccacgaaaagtttagtattttctgtgaagtaatatccaacatcaataacggccgagtagtaacttgaattcttgctactgtctttaaatgaaactttgcggttatagtgattatcgtatgcattggcattaacccaattgctgtatttcaataaggcattaaattctaattgttgatagcgataacttcctgctaagccaatataaagcatatcaaatttttgtttataaccaacgccaacaatgccgtcaggagcagtaaagatatttgtgtcattattataattaaagttaccaccataagctgtccagctttgattgttttcctgataacctaaaataggcccaacccgataattgtattgttttaaaaaccaaatcttcgcatttatgtctatttcattggcataattcaaattggttttttcgtgatgagaccaatcactccactgtgtttgttgtggggtaagccaatcataattatccatcactccctgacctgatgaaagcgtgctccagcccttggctgttagggttagtcggggtaacgcatcccaggcgatatccatttttacgatgggtgtattgttggcttcccagtttaactgactgagcttttgtttaggttcactggattgataaacagattcgattgactcggcattcaataatccaagcgaggtgctgacagtcacgttgcctgctgtatccgtattattgttggccacggcaggatgactcagaataagtaatgccagtgcgccggcccctttttttgctagtgcttctttattcatttttaacctttaattcacttaaatcatcatgattaaaactaacatcgataaagatttaattttttaaattaaagattaaaaaaattttaaaaaaattaatttctcattgagagggccggtaacatgctggtgagaatagatcccgggccaatctacccggataaatttctgttagaattcattgttcaaccattcatcggcttcatcaaacatctcttcaaccaaacggttgagtactgacttttcttgtttgctggcattggtattgatgccattggcatgcatcgctttgacgttaacctccgcatcggggaagacacgatgtacgcgcttggtgagctctgctctaataatttcagtggcgttagcaagggaaccgacattccgcttgtcataaattaattcaacacgcatgactttttcctgaacaataagtactgtgataatatacagtatttgtgggtggcagacaaccctgatggcataaataaattaccgcaggtgatttgttggttaattactggcggttattttttatataaaaagataactggttgtatagacacatgatttagttattttattttgtaattggtttttaaggaaacggacggcctggctaatctatttgcaaccaacgggcatcaacaaccacaccgagtatcttacagttaccgttcagttcaattaaccgatacgcgggattcaagggtttcaagtacttaatgcccgcatcaaccactaacttcttaaatgttgcttcgttatcatccgtcagtttggcgatcacaaaattacccggcatgggctctttttctgggtcaaccagaataatcatcccttctgggaagctgatacctgatggcgaggtcatggaatcgccttttacactcaaccaaaatgcactctcatgggcatgcttggtcgattcaggccagatctcaatgtcacgcagcgtatacggctctatcgcttcataccagttacccgcgcttatccaactgattaacggatagctattagcgacggaaaccgcgggtttatcctttgcacctgagcgggtagtgatggacaggctctccgccatttttgccaactctttggccagagaagggctaaagctactgatgggttcattcagtacttttgcaaaagcagccgcgttggtgatattgagcgggtttacgccgttgaggaactggttgacggcactttggccgacgcccaattcatgtgcaacagattcctgggatatacccagtgcttttttcttcgcattaaacagctctttcagccgcttagcgtcatctaactgttcgggcgttaatggcttctttttcatgagtcaattttattaccgttagcaataatatccaatcacttgcggtgttgactataaaatcacttgcggtaataatcaatcgaaatgtataagggaagtgcatgggatcatctctgaaaagcctagcgccaaggtgctcaacgggggatgtgacacgagttgagccggttagcacccgcagacagcagccagattaaccggtgattttcgttgttgaccaataaataggcagaggtgtcatcgctgaccccgccttttgtggagtaagggtatatgagttcattaaacggtccgcaagccggaaatcacagtcagaagagccagggtatgagagacatccaattggtattagcgcggtggggggtatgggcgaggtatagctcggggctggattattcatcgatagccgcaggtttcaaagggttgctggccgatacctctaaaagtaaggcgtcatgttgtgacgatgatggcctggtggtcgatggctgtgttgcacgattgaaacaatgtcggccaaatgaatatgaattgattattcgccactatgtccttaaccagtcaaaacgggcgattgcacggcagcaaaaaagagacgaaaagctgattaggattaacatgcagatggccgaaggtttcatcgatggctgtttggcgatgctaaatgtgaaattaaccatggatcccttcattgagaatttacctatttatgaacagccatcagcacggtccgaagagaatgcctcagcctgatattttggggagatgcgtggcacacaaatattcacaattctttgtgaaggactattttagtctaaaataaataaagttatttaataacattaagttaaattgaattttcataaattcattattttaaaatttgtgataacagtcatctcaatgtgaagcccaaagcttaacaatagtgtcaattcaaacggtttcacaggagtggctgagatgtctattcaacttggcgtgattgcagatgactttaccggggcgactgacattgcaagttttatgtcagacagcggctggaaagtggtgcagtttattggggttcccacgtcaaataatctgtgccctcctaataccgatgctgtcgtgatcgcgttgaagagccgctcaattcccgccgctgaggctattgaacaatcattggcctgcctacagtggctaaaagagtgcgcacaagctcggcaaatctatttcaaatattgttccacgtttgattcaacgcccgcaggcaatatcggtcaggtcagcgatgccttgatgtctgccgcgggggtgcaacagttagttcactgtcctgcattgccgcagaataagcgcactgtggttcatgcccatcttttcgtcaatggcgtgttgctgaatcaatcagggatggaaaatcacccgctcaacccgatgcgtgatgctgatctacggcgggtactggcgccacaaattcatggcgcggtgggttcattgaatctcgacgctattcaacagggtacattggctattcatcagcgtctggttgcgctatcagcacagggctgcaaccacgtgattgctgatacgctcaccccagctgatttggatcagctggcactggcgttagcccagcaaccattacttgcgggcggttcgggtttagggggggcgttggcgaaacggtttccttctatttttatttcaggtgcggcttctacgttagatgcggcttctacgtcaggggcgacgaaatttgcgtttccgattaagcggaaaaccgtggtgctgtcaggcagttgttcagccatgactcagcggcaagttagcacttactgtcaacaggcggcacattttgcgctggatgttgggcgttgtcttgaggtgaattcaggttatatcaatgatattgctgattgggtgatggcacatagctgcgaggcgctggcgccattagtgtacgccactcagccgtcggatatcattcgtgaaatccaacaacaatacggggagcagcaagccagtctggccgtggaagccgcgtttgctggtttggctaacgaattattagcccgtggtgtcaatacgttcatcgtggcaggtggtgaaacatccggtacggtggtgaaacaacttggcgttaatatgttggaaattggccaatcaatcgcacctggggttccgtgggtacgcgaccctcagcgtggtctgatgctggcactcaagtccggtaattttggtaatgaacacttttttgtggcagcacaggagtatgcagagtgaacagccccccattttcagagccgccaccatcttcggagccgccaccagcttcaaaactgtcaccacctgccaaacaagtacccttttcggagcaacaagtgcgtgatgatttggtgaactacgcccgctcattattctaacgggggttgagcagtgggggttccggcaatattagcgtcaagctgcctgacggtagctttctggtcactccgaccaattcctgcctgggtgaattggatagccaaacactgagtaaactcgatgccgaggggaaccacatcagcggtgacaaaccgtcgaaagaggtgccgatgcatttggcaatgtaccgtgccagatccacgtgcggggcggtggttcatttgcactcaccgtatctgaccgccttgtcatgtctcacaaatattgatcatacgaattgtttgccccccattacaccttactatgtgatgcgcatcgggcgtcttcctttgttgtcttatatgaaacccggcgatccggccattgccaccgcccttgccgataccgcacgcgatcacaatgccgttttgctggcgaaccatggcccggttgtcagtggttcaacgctgcgggaagcggtgttcaacgcggaagaacttgaagatacggcacggctctattttctgataaagccttatgattacagtcaattaacaacctcatccattgatgagttggctcaatcgtaccgcaacaaaataggataatgatgatgatccctgaacagcgtcgtgactttatctaccgctacgtgcatgagcagaatgtcgcatccttcatggatctggccgagttgatgaacgtgtcacacatgacggtgcgcagggatatccagatactggaagccgaggggaaagtggtggcaatcaacggcggtgtgaagctgaacaatctgctcaagcttgagttggcgtacagtgaaaaagcgtcgctgaatcatgagttgaagcagaatatcggtgtgctggcggccatgttgattgaacctgggcagacactgtatcttgatgctggtaccacgcttttcgaagttgccaaagcggtcgcggccagtaactgttttaacctgaccgtggtgaccaatgatttcactatcagtggttatctgatggacatgccgcatattagcctttaccacacgggagggttagttgatcgccgtaatcgttcctgtttgggaaatagcgccgccaattttcttaacactatcaatattgatgtggcattcctcagtagcagttcttgggatattgcgcgaggcatgtcaacgcccagtgaaggtaaagccatggtgaaggcggctgtcatgcgcgcatcacggcgtaatattttggtctcggacagcagtaaatttggtaaatatggcatgttccctatctgtaatttacaggcgctgactgacattatttcagatggcaatctgccacttgtcgcacagaaacagatcaaagagtccggcgttaaattacatctggtcaacaaagaggtaagagccccatgctcaaattcgcagccaatctaacgtggttatttaccgaggtgccatttttacagcgctttgctttggccgctaaggctgggttcccggcagtagagtgccttttcccctatcaggaacagatcgccgatgtgcaacaagcacaaaaagcgagcggcattccggtagttttgatcaatgcccctgcgggagaatgggaaaatggccagcggggactcgcctcactgcccgatgctggcgagccgtttcgccacagtgtgcggctggcgcgtgaatatgccgtggcattgggatgtaaacagattcatatcatggctggcaatagagaagagagtatcactttcgatgagcaatatgcgttactgattgaacgattacgttatgctgcagactatttaatggctgacaatatcagggtgcttattgaacctttaaataatgacaatatgccgggttattttatttcatcatttccgctggcggaaaaaataattcaccagtgtgagagaaagaatatttttttacagtttgatgtttaccattgccaaaaaatacacggcaacctatgggccaacctacaacattactggccgttaatttcacatatacagatagcctcggtacctgaacggcatgaaccgaataaaggcgaggtcaactacccttggttattccaacaactggtaataaaaaattatccaggctggattggatgtgaatatcaacccgaaaatgaaacattctcagggttggggtggttgggaaaaaataaaaatatcaaggcgttttcatagcgccgctggccactgtatagctaactgtgataggccacacttcggtgtggctgtcttttttcatcttatataaaaaaacattcacgcggtccgcaaaaaatgtattagtctggcatcactggtttattcgttaccatctatcccggtcgtctttcaagcggcaggggtgttggctgcccttgcttatcccagtcacttagttgttgttgaccttaaaataaataagctcttggggattaatgagactcacccagcgggcagcataaatgctgtttaaatgggtttccgaccatttgttactcggttgctgcctacctgcatcttgaagtcacttgggtataaagaccgattaacttcctgctgtggcaggtttttttgtttctatgctgatgtaattaatacagaaaataatttttaagattttttttaaaaaacattcacgcggtccgcaaaaagtagattagagtgatatcactggttcgttacatactgagtaaacaataagaagccccagcatcgccggggttttttattgctgtctgaaataggcggaagtgtgcaaagtacggaggtgataaaagtacggaggtgataaatgtatgagcaaagccaatttccgtattggtggacaggttctctggctttattttcgctactgagcttgcaggactttatctttattctcggcactatcattagcgtgatatttaccattaaaacctattacgtcaatttacgtgagaaggccgcgataattaaagaagaacagcgcaggacggaaattttacagaattttctgcaaaataaaaccattgaaaatatacccgctgccattgtggtttgtcacaaagcagcaagccaacaagccattattaaacggaggtgaggtattcatcttcgcatggggtcattattaatcaggagagccacgatgacatttattgatgtcaggcgtcgctcatttttatcgggtgaaattatgaatgcagctcaaatccggcaactggcggcagcggcgttacggggaaaaaccgatgcggaagatcgtatctatttaaccgaagcatggccgataaccacctatcccgccattttgttacaaacaccactggaggtgaaagagtcgattggccgtaatgcgccgcagtttaaaaccatcactacactgcgtattagcgggcacatccaactgagcgagggggaaaacccagtcactgtagcagcctcggcacttgagcggttgtgtgaacaaatccagcgggcggtcattaacagctatgaactgacccgccagatccagcaattcgccaaggtgcgtaccacgatgggcatttataccgccttgggtagtgatactgcagcacgtagtgccgctacccgcagcgaaccctctgtagccgaagtaaaagtggagttagatcttgaatattatcaggggccggaggatttctttccgctggaaaccccacaactggcgggcatcgacgtcactattaacatgcctgacggtgccccggaaccgctgatcgcaataaccctctcggagtaatcctatgttcgtaaaaccaatggccggtcgcgctgtacgtgacccggtcaagggcacctttttgcctgaatttggcaccgaggtgcctgataacgcgttttggcgccgtcgcctacaagacggtgatgtcgtgcagatagcggctaaaccagcggcatctgtatttgaagagttaacaacggagagtactaaactatgaccattcctttcacaaatattcccagcaatctgcgcacgccactgttctttgcggaatttgataattcccaggctaatacggcgagcaccacccagcgcacgttgattattgggcaaacacgggcgggcagtacattgcccgccaatattccactgctggtctcatcaaccgctaccgttgcgggtttgtctggtgccggctctatgctgcatgggcaaatggcggcttatctggccaatgacaccgctggtgaaatctatcttttaccgctgagtgatgctgattcgatggtggctgccattggtaaaattaccatcaatacggcggcatcggagaccggtgttatttcactttatattggtgggatccgtgtgcaaaccacggtggtggcgacggatagtgtcagcaccattgcggccgctctggcggcggcgattgaaaaccaacctgagttgcccgtcacggttgttcataccggtgacatggtatcggaaggggcggtcgtggttctggaggcgaagaacaaaggcgcgcatggcaataatattgatctgcgcctgaactacctgggcaacgctggcggtgaaatcacccctgaaagtctggtactcatgatcacccctatggcaggaggagcaggggcacctgagctggccgatgggctggcgaatttacaggatcggacgttcgatttcattattaacccttataccgatacggcatcactggatgcgatcaaagattttctttctgacagcaccgggcgctggagttatcgccagcagttgtacggccacagttttgctgcgcaatctggcacctatggtcagctaacggcggcgggtgaattgcgtaacgatcaacacgcctcactcttggggatccataattcacccacgccagcacatatctggtctgccgcttatgtcggcgcgattgcgcaaagtttgcgtaacgatccgggccgtccattgcaaacactggcgattcgcggcgtattggcacccccgctatccagtcgctttaccctgacggagcgtaacaacttgctgcacagcggtatttcaaccgtgacagtggccgatgacagcacggttcaggtggaaaatattattaccacctatcagaaaaacaaatatggcgcggaagatgacagctatctgcaaattgaaaccttgttcctgctgatgttcgtcacccgattcttgcgtacacaggtgacctccaagtttgcccgtatgaagttagcggcagatggcacgcgctttgcccctggctcggccattatcacgccaaatgtgatccgtgctgagcttatcgcccagtatcagaccttggaatttaacggctatgttcaggatgccaaaggttttgcccgtggattgattgttgagaaaagcgccagtaacccgaaccgggttgatgtgctgtggaccggtgtgctgattaatcaattacgtatctttgctgttctcaatcaattccgcctgcaagcggccgtttaaccataaaaaaggaaataaattatgagcgatacttcaaaccgcctggcgggtacggcgtatgtcaccgtggatggcattacggtcatggtcgcgggtagctttaaatacagcccatccagagtaaaacgtgaaaccgttatgggtatggacggggtgcatggctataaagaaaccatcaatgcgccttatattgtgtgccaaatccgtgacagcggcgggatctccgttagcgattttaatgatcagacccatgtcaatattgtctgcgaactggcgaatggcaaaaccattatcggcagtgcgatgtggtcggtgaatactcaggaagtggacagcacggaaggcacactcaaggtgcgctgggaaggcggctcggtgacggagaactgatatggcagaactggaacgcagtaaaacgatttcgttggttaaacccatcgctcacgacgcaagcaagaccacctatgaggtggtcgaactcagcgaacctaccttgttacaggtacagcaattctacgatgagcaaaccaagtcgggttcgctcagtggaatggggttactgattgccttggtatcaggggtgccgcgcgaagccattaagaaaatggcttttaccgactataaagcctgtgaggtctacatgatgcgttttttagcctactccccaacgggggacgatggcgcgaaataatcgctgacgtcacttactactatagctgggggccgggcgatgcctggtccctgacctacagtggattaaggtggtggtgccagcaggccgagcggattaataatattaaggctggcaaaaatgactgagatatttgattttgacctggctatcgatgctcaggtcactgaatcagtgagtcaaatgaataaggcaataaaagcattagtgcctcaatttaatgaattacgtaaaagtgtggaagcgattaatcacgttatccccttgttcattatgcggatagaaggatttcataatgaatacggcaacataagcggggggaccagaacatcttcggacaatagcttaatgacaagtattgctaacattgctaatagctatataacaggagggaaatttaatcttatttatacgattggttctgaatttgccagtgcagtcagccaggcagccagcgaagcccgaacggtaaataaagtcacgcaaaatgcgggtgcacctattgatcaattcagtcaactatatggggcgatgcaaattcgtggtacagaccaagaagccgcaataaaatcgactgaacggctctataacacgtttaataatatactttggcgacgtgatgagcagggttggaatctgttacaagattatggtttagacattgccagtaataaaaatggaacagtggatgctcctactacgttgacgaatatggctaaagaatttccacaaatggcaccacaggaccaacaccaactgatccatattctcagaatggactctaatgctattgagttattgcgcgagggggggcagctaacggatttactggctaaatcaagacaatatggcctaacgattgatcctcaacttaatgcccgattaactgagttaaacatacgaacgaatgaattaagtatggcttgggatggcctcaaaggtaaggcatcgaataagctttacgatgtattgttctctgacggtacgatcgccgacggaataggtggccttaccgacatgataacttatggcccagataacttttcgattatgcgtaccctaggggtaacccaagggattgatacggataaaatgcgtcggggttataacgatgctgatttttatcagcaacttaatttttatgaaaaagccatgcttagtgcgggactgatgaccgatggatttcgtaaaaaatatcagggaaataatgaagagaaaaatgcgacttcggcagttaatgcagtggcaattaatactgtggccattaatagcgacattcctgaattcaatctaggaaaagatctgtttaattttggggctgaaaccgaaaatacttggaaaaataactggcttacagatattcacgcggaagaaccctcatccgactttggctataatgatattgacatcaatcctgtcaatctatcacttatttcccctgaatcagcgggtgactttaacggcaacgctattgctgatgtcattgccaccgcaatgcaaaataaccgggtgcaaattgagctgacattaatcgacagccggactggtgaaacttcgctgatccaagcgcagggcggggccagaattgcccacgccatggaactcggtcattaatttaagtaaaaacgcaatgtagtcaacccgcccctgtgggtttcagactgctgacaaaccccgatgacgcgatcttgaacggtgaggataggcagaggagtaaagcgtccgcgccaaggatggcgcggctcgagcctacatggatgtatttacggcgtctttacgatctgtctgttctctccgtcgcgggcactttgtcaataacctcgaacccgctccagcgggttttttactttctgtaaaccgaaaaccggacaggagaaaaaatgtcactcattggcaacacattatcagcgttattgggaggcagtgacgacagctggcaatggtcggaacaccttcatcgagcctcctttcgtggcgttccctttgtggtcgtcagtgggcaaggtacctttggtcgccgccaggtaacacacagctacccctatcgcgataccagctatatcgaagatttgggccgcaatacgcgcaaaattgttctgaaagggattttgatacaaaacagccagatctataccgcacctgatgtgatgactcaacgtgactcattgattgcggcttgtgaaatgtcggggccgggcactctggtccacccgacactgggggaaatgacggtcagcatctccgaggcagggctattgatcgatgatagcttcagcagtgagcgggtcttttcctttaccttaaccgccatcgagtctggcctgcgtgcctttgctattactggctccgcagaaatgggcgcatccattcagtcctcctggctagggctaagtgctaaagcggttgcgggctttatctcaacggtgaaaggcgaaatgcgctcagcgactcaggcgataaaaaccctgaaaaataccgctgtattctggcgtcggatggtgacgggcacggtcaacgaagccagtaatttgggcaacgccctacgctcaacctttggtcgcaaccgctatggccgctataaccacggcactgtcggaggcagcagcacgggagcgacaacgacggttagccaacaaaatgacacggcggatttatccacgctggtggcgcaacggatggcactggtggttgaaggacgggcggcgctcgacgcggcgttggacgagttactcgccgccaacagtattgaaagccatgccgacagtgtgctggccgtggtcaatgccctgctggcgacgggcatcagtacgcgggatattatccgtatcatggaaaccctggcgctagcccatgacgatactttccgtgccaacgacagtgatagggccgtcgcggatgccagccaccacttaatggccacattatgcactggggcgatgatccaagtggcagcgcaatatcaaccggaaagctatgacgatgcggttgcggtattgggccgggtttgcctggtgattgacaatactgcactggtcgccgccgacagggggaatgatgagacctatcgtgcgctggtgcagatgcgtgaatctatcgtgaccgtgctacagcaggcgggggccaatctatcacgggttggcgaggtcagttttaaccgttcactaccggctttgatgctggcaaaccgcctctatcaggatgcgttacgcggcgatgcgctggtgaaaatggctaatcctattcacccggcatttatgcccatccgatttaaggcgctgaatctatgaatgatgacttaacactggaggtgggtggccgggcgatcactggctggagcaaagtaaaggtaacgcggagcattgaaaaattacccagcagttttgaactgtcactgatggatcgctaccccgccagtggggggcaacagtgggttaaccccggcgatccctgtgtggtgaagttaggcaatgactcggtattaaatggctatattgacagttgggataacgccatcacggccacaacccacgtggtcagcgccatgggacgtggtaaatgtcaggatctggtggattgctctgccaagtggcctaacagcgtgatcagccaatcaacggtgttacaaatcgcacagaaattggctgaaccttacggcatcaccgtgacctccgatattaccgacatgaccatcgtaccgacgttcaccctcaattggggggaaacggcacaaacggtcattgagaatgtgacccgttgggcggcactactctattacgatcagttggatggcaacctgttgctaacccgtgttgggaatcgcaaagccgccagtggcgtggcgcagggggtcaatattctgagcgccagcctgcatacggacatcaataagcgctttgttgattacaccggtgtcgtgctctcgaccaatgcggttgccaggcgctcgccctcgggggggaacaatacctcggtactggtcagagtacaggatacacaactggcggcgctgttgccggatcgctatcgcaaccgcatcgttatcgtcgaaaacaccatggactcaccgcaactggtggaaaccagtatcgattgggaaatcaaccgcagcgttggtcgcgccaaagtccttacgatacaggtagatagctggcgcgatagagaacaacaactgtgggaaattaactcgcttatccctatcgatattccggctttagggctgcgggatgagttgtggttgttatctgaagtggtttatcagaaagatgcaaaaggaacggtggcaaatatggtcttgatgccacccgctgcatttgacgttaagccctataaaataaaatgaaacaaggggttaaccatgagtgatgtcagtgggcaaatctcaactctataccgacagataaaaatgctgctggggatcgggcgggtgaccgcttttgacgacagcaacggagtgcaaaccgtgcaatatcaaaccccgttggaagtccacagcgatacgccaaggttagctgaatttggtttctcgtcgggattgccggcgggcagtgatgtggtcattggtttcctggggggtgatcgttccagcgggatgatcatcgcctcacatcatccggcctatcggcatatggggctcaatgcaggtgaaacggtgatttacgcccagtgggggcaatttatcaaactgaccgagagtggggtggtgattgaggctaacaaccagccggtgaccgtcaataatgcgacagaggtgaccgtaaatgccacggtaaaagtacggttaaatacgccgttgcttgaggtaagcggcaatatcattgataacgccgacagtaatagcgccacgctaaaaagcttacgtgacgcctacaacagccacaatcatcaacttaaaaacgtccagtcgggcagtacgacacttaccagtgaaacgcccgctaaggtggtgcgatgacaaccgatattaagaccgtttgggatgtaaatgctttgctgggggattggcagaccggtaacggcggcttactggagggtgatgacttgcagacggctattctgctgagtttattcactgaccgtttagcgcgggcagatgatgcgattgatagccctgatcgccgtggttggtggggtgacagtggtgcagcatcggcgattggctcgcggctctggctactgcggcgtgagaaactcaccacacaagtggctatcaaagcggaggattatgccacagaggcgctggcatggctgatcgaagatagtgtggtggccgcgattaatgtccgtgcgcacattatcgcccccaacaccctggtgctggtggtgagttaccaacaacccagccaaacacgatcagctaatcaaacacagtcatcaattaaattttcatgggtatgggaggagtaattcatgccatttaatcgacccacgttaagtgaattgcggcagcggaatcagtcttatattcaatcggaactgaaaaccggcggcaatttattgcgtttctctaatatcggcgtgatcagtgatgccgatgccgggatggcgcacctgcattacggctatctggattatatcgcccggcaagccaccccctataatgctaccgacgagtatctggcggcttggggggcgctgaaagatgtgttccgcaaagcggccaatcccgccaccagtaacgaggtccggttcagcggtattgccgggcgagttattcctgctggtcgcctgctgaatcgggccgatggttaccagtatcagcttgataaagaagtcattattgccgagcagggcagtgcgctcggtgaaattaccgctatcttgcccagcccgttggacgatgcaactggcggcggcaatcggggtaacagcccggcgggaacggtactgacgctggatattgcaattgacggggttcaggccacggccaccgcgttgactaaaatttctggtggtgcggatattgaatcagaagatgcatttcgttctcgaatgttattggcctaccagaacgtcccacaaggtggcaatgacaccgattatcaatcctgggcattagcggtaccgggagtcactcgctgctgggtgaaacggcggttgatgggggcgggcaccgttggggtgtatatcatgtgcgatgataacgaccacggcggcttcccgcagggaactgacggcatctcatcccttgaagagtggggggcggtaaaagccactggcgatcaggggcgggtagcggacgcaatctatccacaacaacctattattgctctggtgtatgtttgcgcgcctgtcgctcaagcgattgattttgtgatcagcggcatctcttatgctgacagtacaacaaccgccgccatcaataccgctattgatgaggtgtttttcaccgaagggcaacccggtggaaaaatcctgtggtcgtcgctgttgctggccatcggcgaagtacctggaagcggggggtttattatggcatccccgtcggccaatattgaactgcaaactggcaaactccccgttcggggtacagtgagttacctatgagccgctattccgtcagtgaatataccggagcgttacaagcgctgatgccgatgggattagtgtggccccgacggcccgatggcatacagaccgaggtactgcgggcgttggcgaatgcttaccaacgcagcgatgaagatgcacaagatctgctgtcggcggctttcccggccaccgccacggctctcttacctgaatgggaagcgacactgggcttgcccgatttgtgtgcgattggtgagatcgatagcatgatccaacgccagcgggcggtggtcgccaaattgtttggtattggcggccaatcggcggcgtactttatccgcgtggcaaaggctctgggctatgacattaccgttacccaataccggcaagcctgcgcgggtatgtcggtgtgccgtgatgcattgaacggtgaagagtggccttttacctggctaattaccgcaccggaaaccaccattcataatgcccaatgcagcttaacgtattgcagtgatccgctgcgttcgtggggcaataaacagcttgaatgccggttagcggtattaaacccgtcccattctattctgaagtttggctataccctgcttagttgatatttcagtgtgtctatctggcggccacgccaagtacttcgggtcattattcattaaccatttctattttatcgctttaaccagtgaggtattaccatgcaaaaaattggagatattcctaatacacgcgccgacagtaacggcgaatttaccgacggcaacgtcgccggtggcgttccacccaccctattaccggctgagtggtttaatactattcagcgagagttggtcacggtggttcaagatggaggattaaccttagatcctaatgacgatactcaggttttagccgcactgaaaaagctatttttgcagtctggtaataatctctctgagataaaagacgccggtccaacggctataacacagactctcgcaaaccttggtttgggggaggcggcaaaattgggtgtggcaactaattctcagatggcggcaggaacgaacgtatccttacttccttcggttgctgctgtgatgagcatcttcagtaagcgtacttttaccggtaatgattatatcagaattcctgatgtgcctggaggtttaattattcagtggggtctcttgcctaatttacttcagaatattaatacatcgtcagcatggagtgctttattaccaattccgttcccaaactctattattggcgggacagttacgactggtgccacacaaacacccttatctagcggagcgactttatcaaacaccatgggagaacttggaatggtaacgactattgcaggatatgtccaaaacacccgaattgaccaaggtgttaatatctactacatcgcaataggatactgatatgaaagctttatttagccctaaattgataacgtttatcccagaaaatatggttgtagatggaagttatagtcacaatattacagatagccttattgctgttactgatgaagaacttgcaacgtattggcgtcaaaattcacccgatggaaaaacactaggtgttgttgatggacgaccaatatgggtaaatttacctctgccattacatgaagaattagttttgggttcctctactaaaaagagccaattaaaagctgacgcagactctgaaattgactggcgacaagatgccgttgatgcagaagaagcaaataaaaaagagatatcggcacttgctgcatggcgtaaataccgcattgcacttatgcgtattgatgtttcgcatatgccaatcacatggccaataaaaccagaatagtaaatagctaaccgggcgtaattgcccggtatatttattaattcactgaggtaccgtaggaaaaattataaatagccactgttaccgcggtaactgcgtagctatctttatcaaattatctttatgccgctcgcacaatgtagttcaatgtgatgttgaacgggcggattgtaaatgttcgtgagccgcccctgtctctaaccgaaggaattcatcctgtattgacgaccatgaatcagcattacttgcctacatctatcaccaccatcgctgaagtgttcgtaaatacggggtgcctgctaatgtgatagtaacactcgatatcttgctaacataaataactggctcgtccatggccccatttcatgctacattcgcgtgtcttgggccattgcaagcgccctaaaggcaggtcgctaacgggaattcaggtatcaatatgtttacttataaagaaatatcgacgctgaacgaattggaattgatagtttataattacatcataaaaaatactgacaaagtgatgtacatgacgatcagggagctcgcagatgcctcgggtgtttctaccaccacggttttacgattttgtaaaaaaatgaactgtgatggttattctgaattccgtatccggtttaaattatatttagaacatgatgagaaaccaccagttacctttggcatcagtgaaataatcagttattttaagagcattaataatagcgagtttgatgagctattagataacgtagcgaaacagatagcggcaacgcgcagagttatttttgttggtataggcacctcgggagcattggggaaatacagcgctcgcttcttttctaatgttggtaaatacagcacctacattgatgacccctattatcctattaacagcgacatgtatcaggacgcggtcgccattatcctttcagtctctggagaaacagaagaaattattcgcattgccaaccaatttagcctgcaaaattgtaaaattatcagcctgaccaacagtgaaagttccaccttggctaaaatggctgatctcaatatctcctatcacatgcccccggttatccttgaaggccagtataatattactacccaaattccggtgctatatattattgaaactattggcaagaaattacctcagctaatgaataaaaacactaaataaaacagggtgtttttcacatgtaacatattacaaacggtacattttgttatatcgtgacttcgcttttctttttgctagaatccctcctcgatatcctgtaaatacgcataataagccgataacgctctatttattttagggttggcaccccgcgacaggagatgaataatggcaattgatcacacattgaccgcccagcacgtcatcagcttgttcaatgttgatgaaagcgcgccgatactttccatttatagggcacctatttgcccgcagttattagggagattgttatgagctatcaacagttaccgaaagattttttatggggtggcgcggttgcggcacatcaggttgaaggcggctgggataaaggcggcaaaggcgtgagcattgctgatgtcctctctggtggctcccatggggttgaccgtgtgatgacagacggagtactggaagggtatcgttatccaaaccatgaagcagttgatttttatagccattacaaagaagacatcgcgctgtttgccgaaatgggcttcaaatgtttccgcacctcaattgcctggactcgtatcttcccgcatggcgatgaacagcaacccaatgaagccggcctgcaattttatgacgatatgttcgatgaattgctgaaatacggtattgaaccggtgattacgttatctcacttcgaaatgccgtggcatctggtcaaagaatatggtggctggaaaaaccgtaaagtggtcgatttctttgtaaaattcagtgaagtcgtcatggcgcgctacaaaagcaaagttaaatattggatgaccttcaacgagataaataaccagcgtaactggaaatatccactgtttggttattgctgttctggtgtggtgttcactgaacaagagaacccagaagagaccctgtatcaggtactgcatcatcagtttgttgccagtgccaaagtggtcaagctgggtcatgccattaatccggaatttaagattggctgtatggtggcgatggtgcctctgtatcctttctcctgccatccagatgacatgatgtattccgttgaagctatgcgtgagcgttatcttttcggcgacgttcatatgcgcggttattacccttcatatattttacaagagtgggcgcgccgtggtttcaatatccatatggaagagggggacctcgagactctgcgtgatggttgcgccgattacatggggctgagttattacatgagtaacgcggtctctgcgattaatccaggtagcggcaattcactctctggttttgagggcagcgtgccgaacccacacgtcaaagcctctgattgggggtggcagattgatccggtaggtctgcgttactctctgagtgtgttgtatgaacgctatcagaagccgctatttattgttgaaaatggttttggtgcgatagataaagtggcagcggatggcatggtgcacgacgactaccgcattgcttatctaaaagcccatatcgagcagatgaaaaaagcggtatttgaagatggcgtggatctaatgggttataccccatggggatgtattgactgcgtatctttcactaccggtgaatacagcaaacgttatggctttatttatgtcgataaaaacgatgatggcaccggtacaatggcgcgttcacgtaagttaagttttgattggtataaaaaagttattgccagcaatggtgaagttctttaatacctaatcgccagtgagtcctttactggtttgaattcaagaaggccgttcaccctttggtgagcggtttttaccttgttactcataacgcctaaagcgccttccttttatttagagtatagatgttatgaggggaggctgttaactaacgtcccattccgtttaaactccgtgcatagcgtgatttttatattttgagatgcgagatataaactaatatctttcatatcaaaaggataacctattatcccagtttttaatttaaactctttaagttcacttgagagaaactttgctttgactaatactgcggtcctaccctttgagaaaggatttgaagacaactcttctatcttgtcgttattttctatatagcgccaaataagatcaatatgtttgttgatgtaagctgggaaggcgtaatcagtatgggtgtcaggaagcaagaaactgtgataaccaacagttattttaattgctgatgtcattctatcatccttggtggtaaacgatgttttggcaattaacacgtcataacaatcattatattcaccgacatttgaatataatagcaagtgatgtaaatcacaaaaaatagagaggatgctgataaaaagcgtttttccgttttatcctactcgttgtgctattaacttttggggcacaccacggtaataaaccaaaaggcaggaggctgtgtgggcaatttggaggccgtgagtgcaataaggatacggtcattacataaatgtgatgacaggctcggctcgaaattgccagtggataattcagcgacagcggccaggtgttcggtatgcctcggtttaattggcaccctctagcagcgcggtaacgaatctgcgctgtaattgcgtcagggcatcgaaaagcgccttctgttcttctgtaagcgccatttcgaccccttaaggtttaactggtataacattttctcattaacacgatagcgagtaaaccttactatttcttactatcggttaacgtgcgcccccagccagtgaaagggcttgaaccttatggcgtgggcctttctgagcaaaatagtcaatatgctatttatttagagcgtcctgatttagtttatttatgagctgaagaacttgttcatatagttgcttatcgtcaagttcatattcctctctgtctgagtcgggattatagagatcggccaaacaaaatatgcttgataaacattcgctcaatttttcatcgtctttaagagatatatgctggtcacgctctatcctccaaagctcaatataagcattcgcaaaaacctgcgctgacactctttcattaataaatgatttagcgaattctaaaataactatgctcattgtagaactcctatctaacaagcctcaattactcatgtgagtcaatttcgtttagccagcaattaaagtcttctttttcatataaatactccctgtcagttgtaggtaaatctgccccccccaagcattgaagtatcttccaaacaacctgatcgcttactcgaatgtgatcatcatcaattatttcaaacgcccattcagaggcgcttgcccggtcaagttcccctgatattaactgaacgattttttctctaatatttgctcttgatggctggtctactgacattttatcttctcccttgataattaccgtttgtatcaaaaatacggtgattcttgtcattgactactggtttaggggcaacgctccttatatttccagaatgatctaccgtctcataccatgttcttgtctgacctgacttagggtcccattctctaacaagtctagcacctgccatttctccactagttcttgctggtgtcattgtgccataaaacctaaaacgtccattttctaattctttgataccaccttgcccatacttttcagcctgtcggtaataatcgtttagctttgaactttgcaaagaactagtagcactatgcctaccgatactttccctttttttcgcagaaatactctttagtttttccagtttagatactggattacctctcttggcaccaagtaaaatacccgcaacgagcatagcgccagcagtgttttcattcagcacctgatcaaacccttccgccgcatcgccacccagttttttagcggtatcagcaaacatttccgggttctggttatacaccccacccgcagcaagcagccggcccgcagccttgctgttaatcgtgccgaatgctttcggtaccggcagttcagacacagaaggcctcaccttcattggcgacttcgttggccgtggctttccacccgttcgctgatagttccgacatttcaccgaatcgtcaaatgccttgataatctttgcggcaccctcgaaacggaaagcatggggatcggcagacatcaactgaccttcgccattgatgtagaacagccgggcggggccgtacagatcacttaacatcaccacgtcacccgaaaaaaccaatttttccagtttctctttttcacgtatcccgcctggacgtggctgatctggagatgagcgctgttcacgttcccgcatattgataaggtaacggcgggtattgtgactgtcgtcaaattcatattcgcggcagatacgcgcccaggcagcgtgagggctgattatccgctcgtattcttcaggggctaaattatctcttgaaaggtaatacaaatacattccgggcaggttgaagctcatatcccattccttgtggagttagtcgcaccggcattaccttacatttcttagggggttgtcgtccagtcgcaggataccgacaaaaatccacctgccaaaagaaagagtgaaaatcaattaagtagataatttaagactttaatcgtattaaatttagccatcaattcaacagttgattacggatttaagtgggtagtttttgtatatataagcaaaagtatgttggttcagattgaactaactgaaccaacataaaaacctcgcatgtgataaataatgattcatttggctggctgctttccggcatgtgctggagtgcgtaggcgttaaactgtcggccatcaatacgcggtgatttacgctgatagcctcgcccgcttgctggtggggttaacatccctccgcccgctgatgcttttggcgaagtgctttacattgaatccccgcgccatttccccttcaaacgcagccggaaggtataaaacaccatgacgtcacggtcatgcttgcctttgtccctctatcctgccaaatcacgaatagggaggctctgcgggtcataaggcagtggctgcgaaccgactcaagccgtaagcgttcagaaacccctctgtcagctcaataatctgctggtgctttttgttgccggtaccaaattcttttatccaggcattgaaattatgctgtgccgcatcccggcactcttgctcatcccaaccagtttcacaccgcagccacactccacaaacgacaaaaccaacccgaatggattggttttgttgaggtatttggtcggcatgaaaggatttgaaccttcgacccccgacaccccatgacggtgcgctaccaagctgcgctacatgccgatgctgtggcatttatactacattttactgctgctaatgcaatacctaaggaaatgattgcatgttttttaagcggttagtgtgattttttgagcggcaacgcactagtttgcaataaagcgtttcacgtcggttagcacttgtaacagcaacggtagttgaggtttctcatctttgacctcatgaccttgctgatcataagtgcgataacccccgttattgtccaacacgatagtttgcgttggggtcgtgatgactaatatgccgttgtcgcctgttgcgacccagttgttattgcgctgtgcggcaaacaaatcttccccttgagaataatcttctggggctgttttcacatgcagcaagcgttgcatcaatgtcgtcatgacatcttcgtggttggtcagtttacccacgttttgtggtggggtacccggccagtgcaccactaatggtacctgcaattgctggcgattgaagctgctacccgtaccccagtaattattgccactgtcattgaattcgacgccatgggtggcagtaataatgacgacggttttatcgagttgaccactttgcttcagcgtctcaaggatggccgcaatttgctgatctacctctttggcccccgactgatagttacgtataaaatcggtgggtaaggcaactttttgcccaattaccggatcttgcgcttcggcgggaccactcaaactaatatatgagaaccatgggttgctattggcggcggtactggccagccactgtttccactgagccgtggtttccgcatcagcctgcgcaaccggcgctggcaaggtaaaatcagctaacagcgcttggcggtataatgccgatttaaaaccatcagacgcgaacagaccaaattggtagccttgagcgcctaatgcagtgatgaaagctgaaggttcccgggcggagagaatcccatcccagtaagtcggtgaaatgccataaaacaggccaaataaaccggtatcttgccggttacccgaactgtaatggtgatcaaactgaatgttttcgcgaccaaactcggccaatgcgggcatatcctgttgcaggctgctgacccgaataccatcaaccacgatcaacagcaggttataaccgctgcctttatcattgaatgttatcgggtttagtgggtattcaactgccagagcatcgggattgccttgctcggtcaaacggcgttgatactcttgttgatcgagcagaccgtgtttctcaaggaatttacgggcggtcattggataagagagcggcagattagcgcgctgcatactgataggacgataaaaattcgcatcggcccagatatacatcagatgtgaggccacaaaggcagagatcagtaccgcaactaatggtttaacaaaccgctggcggttgaggctacgcagtttttgccaggcccaggtaccgaacaacatctcgatcagaaaaataaccggcactgaaataaacatcagctgccagtcgcgcgccaactctgtttgctcggggttaacaactaactcccataccaccggattaaggtgtaaatggaagcgggcgaaaacctcagtatccaccaataacagggttaaacctgcggtcgcaaaggcggcagaaagaaaacggagtagccgttgtgacatcaccacaaaggtaagcgggaatatcaccaataaataggcggcaaaaacaagaaaactaaagtgccccagccaactgacaagggcataaacacggccaatcagcgaagagggccaatcggagacaaacaggtagcggctacccagaaccaggctgaaaagaatattaaataaggcgaaccagtgcccccagctgatcatttgggaaactttttcacgatagcgctgacgatttgtcaccatattgagatagcagtcttggccgataaattaatgggctttatcttcacgtaccgaagcctgaagtgcttcagcgaaagaacgtgccaatactttgcgttgcgcaggggcaatgctggtattgatcaggtttgttaccatatttcccaaaaccatcaaagaaagatctgttggggtacggtgtttttccagtacgctgaccagctcagacaggagctgttcgacgtgttcgtcactataacgggatgattgtggcataaaaattgtgctcaacgcctgacaaagtcccacatcttaccgtataaggagaggtttttccgctattttatagcacgaagaatctgtagccattaattgaacgatgctgacgcttttgagttgcagctctaccttatcagtgattgaatacgcccctagccaaaaggagtatttatcatgagtctggatattgaccagatagccttacatcagcttattaaacgtgatgaacaaacgcttgatgtggtgttgcgggattctttgttaccgaccaatgcggtagttgaagagatgatggccgaactgcaccgcgtttacagtgccaaaagtaaagcttacgggctatttaatgagcagagtgaactggctgatgcactgaaacgaagccgtaagggtgatgaagatttccttagctttagccgtgcagcaaccggtcgtttacgtgacgagctagctaagtatccgtttgccgagggcggggtggtgctgttttgccagtaccgttatttggccgtggagtatttactgatctctgtgctaagcagctgtcatagtatgcgcgtaaacgaacagctcgatctgagtactactcattatcttgatatcaaccgcgcggatattgtcgcccggattgatttaaccgagtgggaaaccaacccggaatcaacgcgttatctgactttccttaaagggcgggtagggcgaaaagtgtctgacttctttatggattttctgtccgctgctgaaggcttagataccaaagcgcaaaaccggggtttattgcaggcggttgatgattactgcgccgatgccgagttaggcaaaaatgagcgtcaggcctaccgtcagcaggtttacagctattgtaatgagcaactgcgagccggtgaagagattgccttacaggtgttggctcaagagttaccgaaactgggcgaaaaagatttccagcaattttcggctgaacaaggttatgcattggaagagagtttcccggcggatcgagggactttgcgtcagttaaccaagtttgcgggcagtggtggcggtttgagtattaattttgatgcgctgctgctggatgagcggattttctgggatgcggcaaccgatacgctgaccattaaaggcactccgccgaatttgcgtgatcaattacagcgccgtgctggcagtaagtaattgcccactttgcgtatttagccaataaaaaacgccgcatcagcggcgttttttatttcggcgtcccgaatatcgaaagcgacgcgattaaacgcgaacgaagtcgatatgagtcagttttggcttgaaagcgtgacgctgaacagcctgtactttaactttagtttctttaccgtcgataaccagagtcagtacggaatcataaaagcccggcttcagttcaaggtttttggtggtgtcatggtcgagagcaatagaaatagctgcttctgaaccaccgtaaacgattgccggaaatttatttgctgcacgcaggcggcggctcgcacccttaccctggtcgttacgtacttctacattgatagtggtcattttgttttctcttaaagaaaatttaccctgctacaggcgacccagcaacaggttcgatactcggctttggctgggtaaacccagagtaaagcgggcgacattctagcgaaatatcactcagacagcaaataaaactgcgaatatctccggtcaaatgcggctcaggcaagggcatcggcccgccgaaaacgccccttgtaatcaaataccttctccctgatttgccaccactgcccccgacggcgggcgaccacaaaatccggataacgtagcaacgcctgctgcgcgataatatcagcggcggtgtgccatttaagggcaatgcccggtgcgcgctggtgagggcgcaggaatatctgttcgaatgccatacgttgtgcaggtgtggttaatcggaagcgctcactggtattggtgccatcctcatcgtaataggtcgctttcagccactcgcctttggcgtcttggcccgtttctagctgcataccgccacagcgcaataccagcgcatctttcagtttcagggcggctttcagcatatcgtcgggatcgaccaaaaccgcctggcattgatggcagcgacgggcggcaatatcattttctgctccgcaatgtgggcaggatttaaagcgaaaacggtagtcacattgcgcacgtgcaccctgatcatcctcaaaccagccctgacagcggcggccatagtgctcaattatttcgccggactcagtgcatttcccccagaagatattggcaaaaccacaatcggggcagaagacttgtactggttggctcccgctgtgaggtttgctcgtgcccacttctggcgtgaaaaggtcatggggattacccgcataatccagaatcaagcaatcctctttaccgggaaacagccgcaggcctcggccaacaatttgttgatataaactgatggattcggttggacgaagaatggcaatcagatccacatggggggcatcaaaaccggtggtcagtaccgacacattgaccaaatagcgcaattgttgctgtttaaaggcattgatcagcgcatcccgttccgcaggtggggtccccgcgctgaccaacgcggcttcacctttgggcaacaggccatagacttctttggcgtgctctacggtggcggcaaaaatcatcacaccgcgacgctgagccgcatattcgattatttggctaacaatatgtggggtaattctttgttgttgcttaagttctcgatctaaatctgcctcacggaacaagccatcactgttgctggtcaggcggctgaaatcatactgtacgaccggcatgtccagccgttcaggtggcaccagaaagccatgtttaatcatataacgcagcggtaattcataaatacagtcacggaacagggctttttcatcaccacgagtaataccgtgatagtggaactgataaatccagcctttccccagccgataaggggtggccgtcagccccaacagccgtaactgcggattccccgtgcgtaaatgctgaatgatttgctgatactggctgtcatcttcatcgctgatacgatgacattcatcgataatcagcagagaaaatgcgctatcaaatagcggcagattacgggccaccgattgcacgttgccaaagaccacttttccctcgctttgtcgctgttgcaacccggcggcaaagatatcggcctcaagaccgtatgcgcagtattttgcgtgattctgtgccaccaactctttgacatgcgctaagaccaacacacggccacgggccagtttcgcaagttctgcgatcactaaactcttgcctgcgccggttggtagaacaatgagtgcgggtgtggtgtggcgtcgaaaataagccaccgtggcatcgaccgcttctcgttgataaggccgtagtgtgaacgccattatcgtctctgccagatggatggattcaacatttgcaacactttacagggctgtacaagcgacattgatctcagcctatagctaaaaagtttctattattatgcctgcctgatggcgtctgtgcgagggggcaggctatcaacttggcatggtcgcgatacgttgttttctgaataaatgctttctaacaacagtttctaggatgatagggcaaccgccgctatactaatgagtcaggtaggcagcgaatgatttcctccaaccccttcttatttagcatttttagcattgtagttgcatttttagcattgcagttgcattagcggctctcgttacttggctcatccatggggcttgcctcgtttgtagctctgcgataacgctaatgatttggggatgaaaatgttgggatgacaatttgctgcttcattcatttcaacccgtacaattgacatcctattatcatcaacgggtgtcattatggggaccgtatccatcagtgatacggccatacaacaggcaaaatagattcaatgcgattggacaagtttttatctcagcaattaggggtcagccgggcgttggtagcgcgtgaactgcgggcaaagcgtgtgactattgatggcgaggtggtcaaaagtggtgccatcaagttgacaccggaacaagacgtgcgatttgatggcaatccgttacagcagatggttggcccccgttattttatgttgaacaaaccgcagggctatgtgtgttcgacggaagatcccgatcatccaacggtgttgtatttccttgatgagccagtggcttacaaactccatgccgctgggcggttggatatcgatactaccgggttggtcttgatgactgacgatgggcagtggtcacatcgcgtcacttcgccacgtcatcattgtgaaaagacctatttggtgacgttggaacatccgctatccgatgacaccgcacagcaatttgctgacggtgtccaactgcacaatgaaaaatccctgaccaaaccggctcaactggacgttatcgagccgcaacgggtgcgtttgaccatcagagaagggcgttatcatcaggtgaagcggatgtttgctgctgtggggaaccgagtgattgagttacatcgtgaacgcattggtgatatcacgcttgatgatgatttagcccctggtgagtaccggccgctgacggcagaagagatcgccagcgtgggtgccccacacttgtaatgagattgtttgtaatgagattgtttgtaatgagattgtttgtaatgagattgtttgtaatgagattgtttgtaatgagattgtttgtaatgagattgttattgccgtgcgggccagcggttccgcaccgttctactgcggtataatctgcggtaagtttttggaggagtggtaaagcgtgcaaaaaaaccggacatcccacattggtttgatttttatccttgggttgttgtcgatgctgatgcctttggcgattgatatgtatctgccaagcatgccgattattgcgcaggagtttggggtcgagagtggccgtgtgcagatgacgctgagcgcatatgtgctgggttttgccattgggcaaatgttctatgggccaatggctgacagcatcgggcgtaagccggtcattttttgggggacgctgatttttgcgcttgcaggtatggcatgtgcgttggtgcagtcggtcgagcaactcattaatatgcgcttcctgcatggcttatccgccgccgccgcaagtgtggtgattaatgccttgatgcgcgatatgttcaccaaagatgagttctcccgaatgatgtctttcgtggtattggtgatgacgattgcccccttgctcgcacccattatcgggggtgcactgttggtgtggtttagctggcatgctattttctggaccatggcgggggcggcactggttggtgcggtgttagtggcgctgtttatccaagaaacattgcctcctgaacggcgacagaaatttcatctgcgcacgaccataggtaattttggctcgttatttcgccacaaacgcgtactgagctatatgctggccagtggtttctcttttgccggtatgttctcattcctcagcgccggtccttttgtttatatcgatttaaacggtgtttccccgcaaaactttggttattactttgcactgaacattgtctttttgttcttgatgacctttatcaacagccgtaatgtgcgccgtttcggggcgctgaaaatgttccgttttggcctgatagtgcaatttgtgatggggatctggctggtagtggtttgtgtcgctggcctaggattctgggccttagttctgggcgtagctgcctatgttgggtgtatcgcaatgatcacgtctaacgcgatggcagtgatattagatgatttcccgcatatggcagggaccgcctcttctttggcggggacgttgcgctttggtattggtgcggtggtggggacgttactgtcgatggcttcgtcgcgcagcgcctggccaatggtcagttcaatggcattttgtattattgtcgcgatgttgttgtatctgtatgccagtcgcccaagtcataaaaccgtgtcataaaaaatagccagcgcccatgccggatggtattcgatatggatgctattcgacatggatggtatttgacatggattgtgaacggtatgagtggtcggccatttacccgtcatccttcaagttgtctgtagcgttggccacgtgcgttactcggcgcatccatgggcctcgcttctgcgaggccgctacaagcagcgttcaaatctgctcccggcactaaaatctgctcccggcactaagtgtcaataacccttgccacccgaatcactgactgagcgttgaccttaacgtaaatagactcatcgggattaatgagccttacccctaaggttcaccctgagtgtttttttcgctactgagataatccctttcctctctcatttcgtcttaatttggcttaaaaaatgataaattcttgcgcttcatcaatatagtaagcatgcgtatcattattgattgcatcgtcatgattgagatcatattgttaattttttgggcaattaagataaaaaatagaaatcatttttcagccgttttatccgtctattttagcgcattagatgacaataaatgataaggaatatacatgtttatcagttcgttatgataattttattaagattttctaatgtcgttttgttccaaaaatgtaaatatttaactgctattaagtaatcgtcttgcaagaaaaatggttgagctgacggccattaaggtataaatataacgaaaaatgggatctgaatcccaaatctacagcttctgttcctgctaaagacgccaaaaagttcaaaaatcagcacacaaatggatttgttagtcataagtttctcaattgttatcagtattgtgtttttatgagatttgaatcaggcacaataacaatttagcgactataactgtagttaacgtgagtcatgtagttaacgtgagtcatgtcgttaacgtgagtcacggtggtgtttttggtaaattttgattttttattttgactaggaaagacacgtgaataatattcaactttcggtagtacatcgcctgccgcaaagttaccgttggttgtctggtttcatcggggctaaagttgagccgactccgttgacgacgatagacgatacccaggatctgatggggttgaagttactcagtcacgacggtaatcatgccaggcatatcatgcagcggctccatctttcgctgcaagatatccaagtgaattcatccatcattgaatgggaaggtgagccgtgcttgtttgttcaccggcaggatgaaagcgcgacgctgtgccgcctgaaagatgtcggtgtggccattgccgaaacgctaacggcagaataccccttctgatactttttagctgtttgtccgtgtgctatcgcgggcatttttgtctaggctacagcaatattagtctgctaattctaataattgctgagtatatagttgttttggtgccgcaaatattgcctgacaatcaccttgttccaccacttctccttgtcttaagacaatcacctgatggcagagcgaacgcacgacctgcaagtcatggctaataaacaagtagctgagttggtaacgctgctgaagggatttcagtagggccaaaatttgcgcctgtaccgatttatccagtgaagacgttggttcatcaaggatcaacagttggggttgcaggatcagcgcgcgggcaatcgcaatgcgctgacgctgcccccccgagaattcagttggataacgagagcgggtggctggatccaatccgacttcttccattgccttaatcactcgctcttcacgttgcgctgcactgagtttttgatgtacttccaggccctccgcaatgatctgttgcacattcaaacgtgggttcaatgctgagtaagggtcctggaagaccacctgaatacggctgcgatagggcagcatctgtttgggggtaaattggtgcagcggttgcccgctaaaccagatttcaccctgtgatggcaataagcgtaacaaggccagaccggaggtacttttacccgaaccggactcccccaccaagcccagactttcgccgggcttcaggtcaaaactgaggctttttagcgcatagtggtgatcaacggtacggcgcagtaaaccacgtttgatcgggaatgcaacttgcaactctttaaccacaagcagtggctgggtattctgcgcgagtggcaacggggcaccctgtgactcagcatccagtaactggcgagtgtaggggtgttgcggggcactgaagagcgcctgccggttgttctgctccactttacggccttcccgcatcaccgccacgttatccgctaatcggcgcacgatattcaggttatgggtgataaacagcaggctcatgttcatctcttgctttaactctttcagcaagctcagaatttgcgcctgaacagaaacatccagtgcggtggttggctcatcggcaatcaataatttgggttgggttaataccgccatggcaatcatcactcgctggcgttcaccgccagaaagttgatgaggaaaatcggctaatcgccctttggcattacgaatgccaactctgtcgaggcattggataatttcagcccgcgccgcttcttgccccataccccggtgcagtgagagcacttctgccaactgtttttcaatattatgcagcgggttgagtgacaccatcggttcttggaagatcatcgaaatctgattaccacgaatgcgccgtagtgttggctcattagcatgtagcaatgagctgcccgcaaacagaatatcacctgtgggatacactactggcggtgatggtagcaaacgtaacacggacaacgcggtgacgcttttccccgatcctgattccccgaccagcgccagtgtttctcctgcgttgatttgtaatgacagttcgctgacaacctcacgctgaacgcctgcctgactaaacgcaacactgaggttttggatatccaatagtggtgaggtcgccatatcagtacaccttacttgggtcaaaggcgtcacggacagcttcgccgataaaaatcaatagggacaatagcaccgccagcaccagaaatgcggtgatccccagccaaggggcctgtaggttatttttcccctctaacagcagcccacccagtgatggtgaacctatcggcaaaccaaaaccgaggaaatccagtgaggtgagggtggtaatggagccacacagaataaacggcaagaaggtcagtgtggccaccatggcattaggcaacatatggcgagtcatgatggttcgatcacgtacccccatcgcccgtgcggcacggatataatcataattgcgggtccggagaaactcagcgcgcacgacacccaccaaccccatccagccaaaaataacggtgatagcaagcagccaccagaaattgggctgcacaatgctcgacagtaaaatcactaaaaacagggttggcataccagaccatacctcaataaagcgttggccccagagatcaaccctgcccccgtaatagccttgtaccgcaccggcgcagatcccaatcacactggaaaacagggttaatgtcagcccgaacaacagcgagatacgaaagccatagatcactttggccaagacatctccgccggtactatcagtacccagcaagttggtacggcttggcggagaagggaagggcacgtccgtggcgaaattaatggtgttattactaaaacgaataggtgcccagatagcccagccactgtcatttatacgcccaatcacatacgggtcttgataatctgccgcggtggttaaaacaccgccaaaggttgactcactgtaattgaccataaaaggcatataaaacttgccctgatagctcaccagcaatggtttatcgttggcaatcaattcggcaaataagctaatgacaaacagtgttaggaaaatccacagtgaccagtaaccacggcgattctgacgaaaacgcgcccaacgggcctgattaattgcacttagtctcatcatcattattggcggccctcaaaatcaatacgtgggtctaccagggtataggtaatgtcactgacgatattcagcagtaaaccaatgagtgtgaaaatatagagcgtgccaaacattaccgggtaatctcgctgtatggtggcgtcgtatcccagcaggcctaagccattgagtgagaacatcacttcaatcaagagtgaacccgtgaaaaacatactgacaaaggtggcggggaatccggcgatgactaacagcatggcgttacgaaagacatggcgatagagaattttttcctctggtagtcccttggcgcgggccgtaacgacatattgcttacgtatttcatcgaggaatgagtttttcgttagcatcgtcagtgtcgcgaaaccaccaatcaccgtggccagcacgggcagggtaatatgccacaaatagtctgtgattttgctgtaccacggtagggtgtcccagttactggaaaccagaccgcggagtgggaataggtcgaaatagctccccccggaaaacagcactaccagtaaaatagcgaataggaaggaggggattgcataaccgatgataattaaggtgctgctccaggtatcgaaggcggtgccattgcgcaccgctttttttatccccagaggtatggaaaccagataaataatcagcgtactccatagcccaagcgagattgacaccggcaggctttgttttatcagtgacatcaccgattcgccacggaacaaactgtcgccaaaatcaaaacggacatagcgccatagcatatcgaaatagcgttgatgtaggggcttatcaaaaccaaagcgctgttttatttcagcaataacttccgggtctaatccgcgtgaaccgcgataattactgtcaccgacctgtgctgcattcagaccggctttagcccctcctaaaccgccatcaccgctaccggcagtaaatccagtggtgtgacccaattcaatattggcgatagcctgatcaactggcccgccaggtgcaatctgcacaataaagaaattgatagtaataatggcccacagcgtaggaataacaaggaatagtcgccgtaatagatatgcgcccacaacagccccctaacgacgttctattggcaggcgagctgccttgttaacatcaaaccaccagctatcaaaccctagcgaataggtgggacgaaccgctggcatcgagagtttatcccaataggcgaagcggctatgattggaataccacatcgggatcatcaaataattccaggtcaatacccggtcaagggcacgccccagagagagtaaggcctctggttgatcctgatggctgacaatctgggcgattaattggtcgatggccggatctttaataccgggtctgttataggtggaatcaatgtaggctgaactccacaagatttgcaggtctgggcttgggtaagggaaggcgttgtaaaccgttgggatcatatcgaaatcccggctgcgtaagcgattaataaactgcgagctgtcaacttcgcggatcttcatcgtgatacctaaacgctgcaaattgtgtttgaacggttgcacatactgaaaatcgctgccgctgggtaatagcaattcaaattcaaaaggtttaccggttttactattcaccagttgttggtctttgacttcccagcccgcttcattcagtaactctttggctttgagcaggttatctcgcgaatagccgctaccatccgtgtgtggtggttgataaatctgggtgaaaacttccgcgggtattttatctttcaatggcgcgagccaagccagttctgcactgtccggataacctgttgccgcatattcggtattttggaagaagctattggcacgctgatagctattgaaataaaaggctttgttcatccattcaaaatcaaaggccaaagtcagcgcctggcggacgcgccggtcactgaagaggggccgttgcacattaaatgctaaccagcgagtgttctgtgccgagttgtcggtaatatcctgtttgacgatatagttcttggcgaagttaccgcccgcatactgcgtcgcccagcttttcggtgaggactccgtccgtaaatcaaaggctccggctttaaaggcttctaaggcgactttgtcgtccaaataataatcataacggatagtgtcaaaattatattggccccggttaaccggcagattggcggcccagtaatcttttacccgttcataagtgacatattggcccattttgtatttgctgatgcggtaagggccgctggcgactggaggggtactgagtgggtcactcagcttatgatctttccagaaatgtttgggcatcaccgggaaaccaagtaggccgagcattttatctttgttaggttcaggaaattcaaaacgtaccgtcagacgggaaatagcgttgactttaacgcctttatagaacaatcgaaattgtggtaccccttcagtcataaatttgttgaaggtgaaggccacatcctcggcagtaatcggggcaccatcatgaaaacgggcgtgggggttgatatcaacctcaatccaactgaagtcgggagaatagcgcgctgattccgcaattaatggatagtagctgccaatctcatcgcttgagggactgaacaatgaatcatagagtctctccgttcgagctgcagaggtaccacgcaatgcataccggttgaaattatcaaatgtgccaatcgccgacagagtaatatttccccctttaggggccgctggattgacataatcaaaatggctaaaatccgatgagtacttggggtcgcccaatatggcaaaagaaacgccctctttaatggtttcggcagctaacccaaaactcatggccgaaagtatcaaggtagcaaataggcgtaaaaacatattgttggcaatctcctgcgaagctgcagataatcattttctcaaatgaaattaccagcttacagggggataatgcaaacattaagccagtaagtttttgttactcatcttttcatgacagaatttagctaaagcttcaacagacagcggcttactgagtaaataaccctgcaagtaattgacaccatgtttagctaaatagtgaagttgttgctcagtctcgatgccctcagcgatagtttcaatattaagtttttttgccagaattaataccgaatctaataccggcgttgtcaccgtattttcgcctatcgtgctgataaagccgcgatcaattttaatataatctaaggtaaagcgttctaaatagatcagggcgctatggccggtgccaaaatcatcgacagcgatttgaatcccttgcgaatgcagccaggcgaattgcttcagggccaactctttttgcaccatacctcgctcagtaatttcgaatacgggggtaaaaatatcggtatttaattgctgcaagagtcgtgatacgtcctgacaaaaatcatcatcagcaagatgggccggtgaaatattaaaggcaagtttagcgcccgtcgggaacaggtttaccataagagcggtatctctgataattaactcaaacaagtgcgttgtcagcggctgtatcaggtgttgagtttcggcataaggaatgaagatatcgggcgaaatccgcccttcagtcgggtgttgccaacggataagggcttctaaacctgatattgtctgattatgtgagcgaaaaaccggttgatattcaacgaaaaactcaccgcgcctaatgccccgtaaaatttcagcttcagcactttttttggtgattaaaatataataagccaagatgcccaccaagccggcaagtaataggccacctaacagggtcattctaatatcgtttttcgttatactattatgataaatcaatatcttaatcggataaccaggtaatgtaatctccctggcgtttagattaggtaactggctgataggtaagacgttagaatcaaaagtagtgatagctaagccatcaataataatcgctgagccactcatttcgttatctgaacggcccattaatagatagggatgcaaactgaattccatcgtcgccaatattcccgtatctccacggcctgcttgacgcagccatacggcaattgcaggcttgtttggcatcatgggggtgccttgctgaattttaaaatccagtggctgggataaattaactttggggtagatcgtactgactggcgtgtgcatttcacccgttgccgaggagcaataagcaacgccttccctgaccaataaaaaggctctgacaccattggtaaaggcggcacgataatgaagagttgggctggcttgttcgcacgattgggtgctcagtgggataagctgagacatggtcgttgttatttcattaaggaaatgagaggcataggtgataatattaccactttgtgttgttaatttattttcactgctgcgatacagtaatgacaacgttataacgacaaaacagataaaaaagcagagcgcgaggaggatactcttttttaccagatggcgtctggacaaaatattgcgggagaacgcactgtttgaacccatgttacgccgttcctcagtatgattggcaaagtatttataccgctatgacttgatgttgcagccgtgctagcaacactaatgtgtttgcggctatctgtgattccaatgactggggcatctgagtataagtaacttacttgcatagcgctaccgctttgccattgagtattcgcgacattaattaaattataagatggcattcccatatccaaatatcatgtaaatatatgattaagccagccaatacggctcaaacaatacgcttaacttctattgttttattttataaatgtatttttttaaaacaaattttcagtttattaatatcgttaattttattatataaaggcgaatattcggctgctctaccgataatgcgagataatttatcaataatgtgacacacattttacacaaaaaaattggcgattgcgttttttgggtaaaaaaggacatttcttacaaattggcggaaaaatacgcagtggaaggtgatagggcagaagatgagccaataaaaaacgctgtcataaacagcgtttcaacgtttggtttggtattttgaacaacaggaataaatagcagctagctgctcgaactgctacttagcactcgacgcccatcacgataacgcttattccagtaatcgtcattcaggttcgatatcgttacaccggcactggtcgatgcatgaacaaatttatcgttacctaaatagataccgacatgacgccctgttgagcctgcgcggaatagaacaagatcacctggacgtaatttagtccgctggactttcttgccgagatcctgctgctgagatgttgagcgcggcaaatccataccaaactgttcacggaaagtggtttgtacaaatgcggaacaatcaataccgcgtttactgctaccgcctaaacgataacgaacacctttccaacctgcatactgttctaaaatctttgacttgatgtcaacgttgcgaaccatcgcttcgaattcatcctgagaggcttgcagtaaaagcccatctttgtcattaactgcacgcatctcagtttgcgtattatttacattcgaagcctgtggtgaactgcatgcggataacattactgctgctgcaactgcagggagcgcccgcagaatatatctcagaataggttgagacttgaccattgttgttgttttcccttgctgtccttacgacggatgtcgctaccaaaaataccaaacgaatcgagattattgattgtgaacagaatagacaatcatttaactgaataaatgtgcatgaacgcacattctttatccaaagcgtctctatcaaacaatctctactgcatcaaacaatctctaccacattaagtgcaggatgctgataaaagcgcagaatgctgatagctgaacacaaacgtttttgaggttaccgtaatgattaataaaaggcgagtgctttattcctattttcatcagaaaagctaatgtaatagaatgtaaactttcaaaaataaaagtgaccgcttaatttatcgtcgttgagtgtgaagaaataagcgaaaaaatagaggctgagacaatgaattgaattgtttgccacagcctgcgatgggcgggggattaaggatgtttagcgccaggcagatgctggttaatccacgcaataatcttatcgcttaacggcgtcagcaatatccaactgatccctaccaagacgattgagagtgatcctaccgcgatatcggtaaaccaatgtgcgccaatcatgatgcgcggcattgagaagataaccacgatcagcagcgcaatagcgaacgcaccgcgggaaaaatagcgcaacataaaacaggcaaaaataatcagcatcatgccatgatcgccagggaaactatcactcgaggcatctttcgtcgggacgccggttaatacactgacgcgattaatattatcaaatgtcagggtggggctggggtgtgaaaccggcagtaaatggcccaactgattaagaataaccgccgttaacaacatgacgaatccgatcactatcaggcgacggcggccagcaggcgtttcctttatgtagaaggaaaaataaagtaatcccatacacatcaatgaaatgacatcgaaagcgcgatggttggtgattgccaccaggtgcagaaatgttgggttggacagtagatgctgattaaaatagaagaatattgctgagtctatcttaaaccagacaccgtggtttgtgggcagataccacgatagaaacagtgtgatccccagtaaattgaggagcaatattgtcggtaaattacgacgagtcatgcggcaacctataaattaaaaatgtacacaacgggaagaaaataaaaacggggagacatcataccccgttacgtaaacgaatttttaataaatcatgttgcaatacgttccaatcaatatcagtggcgctaatcaattcaatgcggctatccagcgggggtatttggcgagtgtctatttgtaagtcattaccttgtcgattaaccatcaaggttccttccgggatgcgcatgacaccttttacccgttctgctgggttcaatcgtacccactccaataatggcacggtatcaaaaacggtgttggcatcaaatacccagccgcagctcagatacccttgcccccgatttaatgcccgacgccagggttcggcccctttcagacgtaatgcggctaatccttttggctgtgatgtgccgtgatgatgcgtaccagaaggaagttcgtctttattacggtgtggttggtcgagcagggccacgtcgagtttgccatattcgctatgatacagcggccgcgataatggctgcttttgttgccattgttgtaacaccgcgttatcggccgagcggtaggtgtcttgcttgttggccacaatgatatctgccgccgccagttggtcacggaaattttcattttcggtatagcggggttcactcagttggcgggcatccagcagacaaagtgtggcgcgtaagtcaatccaaggctgataaatatcagacgttaataatgacagaatttgtttcgggtggcccagcccggttggctcaatgagcaggcgatctagttttgcctgctgcaacagcatgttcaggccaatttgcatcggtagcccattaacacagcacatgcagccccctgggatctcttttaagacagcaccgctatccgccaacagagcgccatcaataccaatctcaccaaattcattgaccagcaccgcccatttttcatgttccggcttctgtgcgagtaagtgccggatagtcgtggttttgccacaacctaaaaacccggtaattaaattggtctttgtcatgctggatctccaaaatacaaaatatttttatatgatttacaaattatatggctatttattaccctttcaaccagaaaggaaataaggccaattaggcttacttttaatcaaaaaatcgccaaatagagataatttcctagggtggctaagacgctggcctaatagatatctactgcgtgaaattataattccttctccgagggattttggcgggttataaatagaatagagtaataaaaaacactctattacgcccattgtactgcttgaaatcctctatctttaagatgacagctataaaagttgaggtgatcatgagcaactaccgtgcactgagtatcgttgtaatcatgttttcatggataatatctttctctgccagtagtacgcaatccaccctttctgtcaccggtacaattactttttctggggccattgttgataccccttgtgatacgtcggtattaaaccagaccattacaacgagctgttatcgtaatggtaaaatgataaccagcagacaaacactcacacgtaatatgcctctgaacgcgcggttgccagggagtttagccacgtcccgtttggaatggctgaatcagcagcgcagcctcggagtcctaactgttacctacctctaatatttctcaacatgttcgggcatcacggtttatcgacgtgataaaccgtgatttatcacctgaagttgtttgaccacatgatatactcgacgccattcatacacccttttggtcagatcaatttggtattttctacgccaatgtctgatgcaggaaattaaggttatgcggttatatcaggaagtgggcagccaactgcgggaagcgattgtcagtgggcgatactcagtgggcgatcgtttaccaccggagcgtgatattgccgaaaatttcagtgtcagccgtagtgtggtgcgtgaagccctgattatgctcgagctggagaagctggtagaagtacgcaaaggctccggtgtttacgtggtgaatgtgcccacgatgtcgcttaatggtgagtcggctacgtcaatcgatagtggctacggcccgtttgaactgctacaagcccggcaattgttagagagcgaagtcgcggcttttgccgcaatgcaagccaccaaagccgatatcattaaaatgcgtaatgctattgagcagggaaaagccgcactgacggctggcgcgatagatgaaagcgctgatgagttatttcattgtttgttagcgcaatcgacacaaaatagtgtgctggccaatatggttgcgcagacctggcaagtccggaaaagtagtgcaatgtggcagggggcgcatagtcataccgccgattttagctaccgttggcaatggttggatgatcaccaaaaaatcttgcaagccgtgcttcgccgcgacagtaaagccgctaagcaggccatgtggcagcatttggagaatgtaaaattgaagttgctggagatctctgatgctgaccatccagattttgatggctacttatttgagtctgcgccatatcagattgaagagtaaaagataacgtaaaaaccaaccgtagtcgcaccaagagtactaacgtcaacagaactaatatcaacagaactaatatcaacagaactaaacgccaacaataccgatgagctgaatagccttgattcagctcatcgtcgtgtgtcttaagcctgttcggctaagcggcgtactgtctctttcgcgccaaattgttgcaagctgagataagcctcggtcactgcctgcacaaatgttggctgttgtggcagcgtttcaccaaacagtgctttcagtgtcagcaaactttgtacccgagctgccccatcttcgctggccgcaacgcattgtttaaagctatccaccatcggatcacggatatcaataacctggccgttatcatcgatgccccctacatagcgcatccaacctgcaatgcctaaagccagacaaggatacgcattaccctgttttaaatgccagcggacggaatccaacatccgttgtggtaatttctggctcccatccatggcaatttgccaggtgcggtgtttgagcgcggggttacagtaacgctcaatcaactgatcagcataagcattcagatcaataccggtgacacgtaaagtgggcgcttgctcattcatcattaagcgacgagccgttaggcgataattctcgtcagccatacaatcattaatatgttgataaccggccagatagcctaaataagagagatacgaatggctcccgttcagcatacgtagcttcatttcttcaaacggcaagacatcatcaaccaactgtacgcccgccacttgccaatctggacggcctgcaacaaatttgtcttcgacgacccactgaataaagggttcgcaggcgatcccacaagagtctgcgaccccaagggtatcggcgatttcctgtaacgtttccgctgtcgctgcgggaacgatgcggtcaaccatggtgttcgggaaagtgacatgttgctgaatccaattagccagcgctggatcacggaccgtggccagaccgagtaccgcgtttcttaccacatcaccgttttccgggatgttatcgcaagaaaggacggtaaagggaggcaatccacgtaaacggcgcaagcggagtgcttccaccaacaccccaggtgctgatgtcggtgcattagggacggccagatcggcacgaataaactcgttctgcagatccaattggccggtgcccggctcgatgcaataccctttctcggtgatggtcagagagacgatggccacttgtggctcgaccaatttcgccaatacttgcatgatgccgtctaaacgagcatgtacggattcacacactgaaccgaccacaatcgcctgattaccctgcgcccctttttccaagacggaaaagaggtggtcctgtttacgtaactcttgaatcagcgtatcagcaccaaagaggctgacttcgcaaataccccaatcaccgccttgcgtatttaatacccggtcagtgagcagtgcctggtgggctcgatgaaaagcaccaaatccaatgtgaacaatacggcttctcagcgccgcccgatcataattgggttgctgtacggttgagggaagggcgctgttggcaatggtgttcataggtggctccagaattattccccctgacagtacggggactgatggggattaacataaaaggtggcaaatagaaaagttgttagaccagttttgtgtggctgatcgctaagtagagagccatacaatgcggacccgtttcttttgctcgttgccattaagttatagacacagaattaagttataaacacagaatgaagttataaacacagaaattatcggcttgcagtgtaaagccatatgacagaaaataaaattggtaagtccaatattgataatattcgtgaagtggatcaaccaatgaggatttgccttttgacactgagcggctaaacagtaaggataaagctgagtgatatctattagaaatcggtataacaacattttcagcatctgagcatcgtttactgtggttaagaagatgacagcagttaaaaaagattaatgcagttaaaaaagatgtgattgggatgtgattggatcgttgcctacgtccgttatcggcagaaaagtccgttatcggcagaaaaaggcggctttaaccgttagcgggttaattttattattgttgcgtatgcagaaggtaaaaataaaatggaacaaacatggcgttggtatggcccgaatgatccggtgtcgttagatgatatccgtcaagcgggtgctaccggagtagtcacggcgttacaccatatcccgaatggtgttgtgtggccagtcagtgagatcaagcagcgtcaggccgaattagcagctaaaaacctggtatggtctgttgtggaaagtgtgcctattcatgaggacatcaaaactcatagcggtaactatcagcaatacattgaaaattaccaacaaacactgcgtaacattgcagaatgcggtattgacaccgtgtgctacaacttcatgccgatactggactggacgcgtactgatctggaatatgaattaccagacggttctaaagcgttgcgttttgaccagatagcttttgccgcttttgagctgcatattctaaaacgccctggtgccagcaatgactatacggcggaagaacaagtacaggcagaagcgtatttcaacgcgatgactgaagctgatattgccaagctgacgggcaatattattgcaggtctgccaggggctgaagagggctatacgctggatcagttccgtgctcggttggctgagtacgatgggattgataaagcgcaactgcgtgagaacatggcttacttcctgcgcgctatcattccggtggcggaacaagtgggcttgcgtatggcggtgcacccagatgatccaccgcgcccaatccttggcctgccgcgtatcgtttcaaccattgaagatatgcagtggctgaaagagacggtggatagcatccacaacggtttcaccatgtgtaccggttcgtatggtgtgcgtgctgataacgatttggtgaagatgatcgaaacctttggtgatcgtattcacttcacgcatttgcgttccacctgtcgtgaaggaaacccaaaaaccttccatgaagggggtcatttgcaaggcgatgtggatatgtactcggtggtaaaagccattttaaccgaagaacagcgccgccagtcactgggggatatgcgtccaatacctatgcgtccggaccatggtcatcagatgctggacgatttgcacaagaaaaccaatccgggctattcggcaattgggcgtctgaaagggctggcagaagttcgtggtgtggaattggcactgaaacggacatttttccccgatctgaagcagtagttttgcacgatcagtgaagagataaccgttaagggccggtttccggctcttaacgtagagagacccaatagattcaagttgcagaagggcggccagcaagagcagccaacacacctgcaacgttaaagatgaaggggggttagtcagcgcggcccatatagcggcgttcagcaatatgaatacgaattttttcacctgggctgatatattctggcacctgaatcgataaacccgtgctcattatcgcaggtttgttacgggcactggcggatgcgcctttgatgctcggtgcggtatcaacaatttccatatcaaccgtttgtggcaactctagcgccagcaattggccttccatcgtcagaacctgcatccccggcatcccaccttcaggaataaacagcagttcatcttcgatttgctcttttttgaagttgtatggtgtgtagtcttcatcatccataaagacgtattcgtcaccatcaatataagagaaattgaccgcgcggcgagtcagagtgatggtgtcgaggttttcatcacctttaaaacgctcttcgactttcaacccggtacgtacatcagaaaaacgcattttatacagtgtacttgcgccacgggcgcttggactttgtacatcgatatctttcaccaacagcaatttgccgttgaggttgactgccataccacgttttatttcgttagcttttgccataaaaataacctgccaatcgggattaaagataagttgcgacaagttactcgcgccgtgagattcaggcaagcagatagcgcgaaaaggtgtaataaattctgcactattgataaaccggcaataggccgaacaaggctgaaatatgggctaccgcattgaccaggccaaacaggataataaaaccaatcataaaacggcctccgggagcacggtaacgggcttgtgggaagcgtttacggctggctcgcgccattaatgcgggcacaataaccgcccaaatggtggcggctaaccccgcaaagccaatggcatataagaagccatccgggaacagcagggcaccgagagtcggagggacaaaggtcattaatgctgatttagttcgcccgctgcggtcatcggtaaagtcaaataaatcagaaatataatcaaacaacccgagcgacacgccaaggaacgaactggccagtgccatataagagaaggcattgagtagctggctggtggctttactggcagaaacggtgtccatttgttgcaatagattgccgatattaccgccatcggcaataacctgtttgaaagcatcccgggcgatattgccctgaatggcatactgccaaaggagataaatcaccaaggcaatcaatgttccgtacagcaggctgcgcacaacggctttgctgtctttgttgtagtacttcaccaggcccggcacattgccgtggtagccaaaagaggtcagcaaataaggcaatgccgccagtgcatagggcagatagtgggcattactgtctgtctgattaaacaacaccgcactttctacatggctgaacatatcaccgacagacatgacaaatgtgataaccatgccgccgattaatattgtactgaggcgatccactgctcgggtggataaccacacgataaaggccaccaaaagtgcaaagataaagcctgcgctggtctggccaattccggctacgttttgcagcgtatgggcgatgatcgaaccaccggcggagatataggcgtaggtcagaatgtagagcacaaaggtaatggacagcccgttaattgagctccacaccttgcctagcaggtcttgcaccatggtgtggaaactggcgccacttgggtagttcaggttagcttccagaatcatcagcccggacactaacatacatgcccaggtgtagatcagcagcaccactgagccgctgaaccataccccggctgtcacgattgggattgagaacatgcccgcacccactgcggtacctgcgacaatcatcgcgccacccaaaacggaaggccgtgacaacggttgggataaggccatcgacatctattgctcctgagatacccggctgcgggtaacttctttatattaagtgagagtcgttatattaagtgagaatcgttatagtcaatgagagtaaccaaattaagtcatcgccgtgcggtattacggttacagctcctttgtactagctgaatggtacactgtgcctgtgaggctgtaaacagatgaataggcttgtattgataaataggcttgtattgataaataggcttgttttgataaatagacttgttttgataaataggcctgtgattggcaatgagtaaaatgcgttgtttgatgagtgcgggaggagagtgctggtagtttaggcgtgcggttgctattgtccggccttattcaccggttattactctctttgttcttattttacttgctcacaggagcctgccgatggactgtcgctcagattgcggagcctgctgtattgcaccttcgatttccagcccgatccccggtatgccattgggcaaacccgccaatacccggtgtgtacacttggatgacaacatgcgttgtggcattttttactcgccattgcgccctacggtatgtgccagcttgcaagcaatgcgggaaatgtgtcatcacacccgtgaagaggcgttggtgtatttgattgcgctggaagcggtgactgcgccttaaatgcgcttttacgatcggctgattctctccgctgccagtacgtgttcctctgcttctcctgactgccctcagatgctggtatatcccgcatcggcagtaatgattgaacctgtcagcaagctggaggcctccgaagccaaaaactgcaccacagaagcaatttcatgggggctgcctaaccgccccatgggggtcatatcgagccatcgcgatacccgccccggctggctggtcaacccttgtatcagtggtgtttctatataggtgggggcgacggcattgacgcgaacgccacgtgtggcccactccaccgccagtgatttggtcaaatggtgtactcccgccttcgatgcattgtagtggcactggggctgcggcacattaacgatttggcccgatatcgaaccgatattgatgatcgagccgcgccccgcttcaagcatccggcggccaaagccacgacaggtgcgaaacacgccagtcaagttgacggcgatgaccttatcccagtccgcgtcggtcatctcttcagccggggtatgggtcacgatcccggcattgcagaccagcacgtccaatggcggtaacgcggcggccagagcgtcaatagccgcgctgtcggtaacgtccagttcctcggcccgcacgttgtagcccttggcgttcagtgcttgtgcggttgctgcagcgcgttcacgtgaaatatcggtgcagatcacttccgcaccggttgccgccagcccttcagcgattgccgccccgatcccctgacctgcaccagtcaccagcgcccgcttcccagacaggctctgtttttcgggataagactgtttttcgagatcaggccgcttttcgagatcagaccgctttttgtggtcattcatcctcttctccttaagtcagtgggcagcgcagtggctcaccgcgcagtccccgtagggcctcttcagaagccagttgttgcagttttttgaccgacgcatccgagaaaaaagcggcatggggcgagagaaggagatggggcgctttacgcaaggccgaatcagccgggaggggttcttgctcgaagacgtcgagtccggcccccgataggtggccacgggtcaatgcctcgattaaggccgcctcattcaccagcccgccacgggcgcagttgatcaggatcgcgccctcaggcatacgtgcgatagcggtggtatcgatcaggtcgcgagtttcaggcgttagcggaacatgtagcgacaggatgtgggccgaggcgatgaccttatcctgtggcagcggctcgatccccgccgaacgggcttctgtctcagtgacatacgggtcgaagccgatgatgcggcaaccgaaaaccgccattcgtgttgcataggcgcgcgcgatgcgcccaaggccgatcagccctaccgtggtgtcacgcaatgaccgcacaccatcgaccatctggtcaatttcccacctgccgctacggatccctgcctcgtagcgccccagtttgcgtgctaacgccaatgtcatggcggcggcatggtcggcaacctcttcaatgccgtaatccggcacattacaaatacgcataccccgttttctggccgcagagagatcgatgttatcgacaccgacgccgtaccgcacgatcaccgcgccggggggcatggccgccatcacccgctcggtcatcggggcgaagttgttcaacacgacatctgcgccctgcacggcatcccgcgtttcatcttcagtgcggcattgataggcggcgaaatcggcaccaaccgcgttggccgctgcttgttcataaacggtattgccgaaagcctgatcggtgacgaccaatctcatttttgattcgctcacagcaccccccgcttagtaaggttacgcatcagcgcccgggttccgtaggtccagggaacggcctcgtcggagtagaccactgtattgtgtaaggtgcccaagagtggtgttgagatttcaaccaaatcacctggctgatgggtaaagcccgcgttttgctgggcgcgatcttgcgtcggagcgaacagggtaccgagaaacaacataaagccatcggggtactggtgcgatgtattgcacgtttgcctgaccagatcggtaggtttacggctgatctcggccatgttcgagctgccggacaggttaaagccatcggcccccgtgaccgtcagggttaagctggcgtgttcaatgtcgtgtagcgtgaagttctcatcaaagaggcgaataaatggcccgatagcgcaagcggcattgttgtctttcgcctggcccaacagcagcgccgagcggccttctatatcgcgcaggttgacatcgttgccaagtgttgccccccggatattgctctggctatctacggccaacaccacctcgggttccgaattactccaggccgagatgcggttaacgccgatctgcgcaccataaccaaccgctgacatgggttgagatttagtgaaaatctccgcatcggggccaatgccaacttcgaggtattgcgaccacaggccctctgcgatcaaggcggctttgaccttggcggcttgatctgagcccgcttgaatattggtcaggctgctaccgataacggtgccaatatgttggcgcaatgcatcggctcggtccggatcaccggcggtacgttcgtcgataacccgctcgaccatactttgagcaaaggtcacaccgcaggctttcagggcttgaaaatcgcagggagcgagcaagcaagggcgtgttgagtgatagcccatctcggcgggggggaggatcagatcgtcaatggtgcctagtggttcgcctgtcaacatggtgaagcgttccgccgggtggtcctctagaaaatccgccattgagattaccgcctcggttatgtcgtacaagatgtgattacgcacgatgacaaccgacgggcctataccgggacgccagactcggccaacaagtttggccttggtgagtgaagtgggcagcatggggcatctcctcttttatgatttctagtaaaactagatattggtttggaagtgctcaaaaatgtcgttcgaaccagcaggggtctatgtttagacccctaatcaaaaagcctgttttagcggctatatatgttaatttcagcgttaacttaatgataaaaataggaaaaaataaggaaaagcaagaaacgacaaacctgcgatactgctcacaatttaaccaattgtaacccagttgttgtgaatttgttgttttttttgaatgggggatcgcgtaaaactagatgagttatgatccgcatcgggctaaaccacgggctcaactgcagatgaaggcgacggagacgcaacatgagtgagtatcatgaaaaaaataatgcactcttcaagtcgattaccgcgttagacggcgctttatttatcaatggtgagttccgcaaaggcgcgggggggcgtctgccagtggaaaacccggctaccggcaaagtgatcggtcatctcgcggcggctactccagaggagatcgaagaggcggttgctgcggcgcggcgcgcttttcctgcctgggctgccgaacggccaaaggcccgagcgaatgcgttgcaccgtttgggtgatttgatcgccgccgatgccctgaatatggcgcggatcatgaccatcgaacagggcaagccggttaacgaagcgcaaggtgaaatactgaagctcgccgaaatttgtcatttttatggcgaagaagcgactcgcgtgcaaggtgacgttgtgccgaatgaccctccgggttttcaaagtcttgtcgtgcgagaaccggttggggtggtgggggcgattaccccttggaattacccggccgaattggtgggatggaagctgtgcgccagccttgccgcaggctgtaccctcattatcaaacctgctgaactgacaccctacacggcgctggccatcgctgaaaaatgccttgaagcgggtattcctgccggtgtcgtcaatgtattgacggggaagggggaacaggttgggcaggcgctggttgaacatccacaggtcgataaaatagcctttaccggctccagcgcggtcggtttgcatatccagcaaagttgcccgcaggttaagcggttgtcgctcgaactcggcggcaatggtccgatggtggtggccgcctgcgcagatgtggctgccgcagttaagggcgcggtgcgtcgtagcttccgcaactgtgggcaggtctgcattgcgatcaatcgtatttatgtccaccgctcatgctatcgggcgtttgtgagcaaaatgggggtggctaccaatgggttgcgccttggcaatgggttggacgatccagcggcggacttgggtgcgatggcctctgtagagccactgaacaaaacgcgtgcgcaccttgaggatgctctggcaaagggggcgcgcttggttgcgggggggaaggcgccagagggggtggaatatgccaagggccatttcttccgtccgactgtgctggccgactgcacacaccaaatgcgcgtcatgaccgaagagacgtttggcccgctggtcggcttagcccctttcgatgatatcgatgaagtgattagtcgagcgaatgatactccctatgggctggcagcttacatttatgcacgagatctggcggctatccaccggctgtcagcggcgttggactacggcaatgtggcaatcaataacgtcgatgccagcatgatgaatgcgccctatggggggcgtaagcaaagtggcgtgggctacgagcatggccgtgaggggttgctggagtatttcaatttcaagcacatccgcttgtaccacggtatcggggactaaaccatgcaggcgcttttgggcattgatatcggcacctcggggtgtaaggcgttgctgatcggtatcgatggtgcggtgatcgccgccgataccgcgagttatccattatctcaaccccaactcggttgggctgaacaagatcctgagctgtgggtcgagggggcgcgtcgagccgtggcaggagcattggctaaagcgccaacgctggagttgctctgcgtggggctatccgggcaaatgcatgggctggtatcacttgatgctgggcatcaggtgttgcgcccggcgatcctctggaacgaccaacgcaatagtgctgaatgcgagcagattaccgaggcagcgggggggctaaaaggattgttggcggcgactaacaaccgaatgttggtgggctacaccggtggcaagattgtgtggatgcagcagcatgagcctgatctcttcgctcgcatgaccacggtactgaaccccaaagactacttgcggctgcgtttgacgggggaggtcgccactgaagtttcggatgcctcggggaccgggcttttcgatgtacgtgcacgccagtgggcgagtgatcttattgagaacgtggggattgaccgcgctttactgccccccgtatttgaatcgcaggtgatctctggccaggtctcagcggtgggggccgagctattcggtattcccaaaggcacgcccgttgctggtggtggcggtgatgctgtgatacagaccttcggttctggggtgatcgctccgggtgagttacaaaccaccatcggcacggcgggcatccttgcagcggtattggatacaccacaggcgaaccccgacgggcggttacaggttttttgtcatgttgtggctgataaatggcactgcatgggggtctcgctgaacgctggcggcgcgatgagttggtttcgtgacacgttttatgtgggtgttaatgcggcggttccttcttttgatcagttcacgccttctgatcaaatcacaccttcttttgagcagatcgttgctgaggcggcagccagcccggcaggggcgcgcggtctgctgttcttaccttatctgaatggtgaacgttgccctcatcctgatcctgcggcgcgcggtgccttcattggtctgacagcctgccatcatcgtggcgatgtggcacgtgcagtcatggagggggtggtccacgcccttgtggatatgcacaccttgatgaagccattgggcatcaatgggcgggttgtaaaaacatccggtggcggtgcacgttcgcccctttggcggcagatgcaggcagatattttcggctgtgatgtccttaccacaaaaggggctgctgaaggcgccgcattcggtgccgcgctggtggcgggattggctatcggggtttggcccgatgcgacgagcgcgacggcgaactgccgtatcatcacgcgcgacccccccaatcccgcaaccgcggcggttgttgctgaggcccaacgcatttaccgtactctttacccggcgctgagagaaaccttcgcagaacttggcgaccccacctttatgtagtcatgatcaggagtcacgcatgagcaatcaacaaaatgacgccaagagggctgccgcccgtcgggtgattcaggatttcgtgttcgatggcatgacgttggggctgggttccgggaccacctcgcatttctttgtgcgcgaactgggccagcatgttgccaagggcttgcagttaacctgcaccacaacttctcgtgcgacgagcgaggtggcgcgtgacgtgggcattgagctctcggatccgaatgagatgaatgagattgatctgaccatcgacggcccagatgagattgaccggcggttcaatatgatcaagggcggtggagcctgccttctgtgggagaaaattatcgcccatgcctcgaagcggatgatttgtatttgtgatgagacaaaaatcgtcaattgcttggggcaatttccgctgccagtcgaaatcgtcccctttgcctggaaacagaccgaacgcagggtcgagcgggtactcgcggaacagggtctccatcatgtgccgattattcggcgtatggggggcgggcacccggtgatcactgacagtgggaactttattctggattgccattgcggggcgattatcacggcccctgaaccgctggaaatagagcttaaccgcattccgggggtggttgaaaacggtcttttcacccgtgaggctaccggtatggtggtgggctattttgacggttcctcctacgttcaactgcgataatcacggcctttttcgacgctgtcgcgagtcgcgtcaccttggcaccaagagagcaaaagagcaaaagagcaaaagagagtatcacagcatgcagacataaaattggagataacccatgacaaaagcaacgcaagcgggcgtgagccggcgcggcctgttggttggtggtgcggtactgggattgggcatggtgatcgggcgaggagcattggcacaaaaccgcctttcgatcccttactcgaataaaagcctcgattactacttctttgtgattcaggaagcatcagtgaaacgcgcggttctggcacgttcgggggagtttcaggcgactaacgccaattttgacaatacccgccaactcgaacagtggcaaagcctactgttgtcccgcccttcagcgattatttcggaccccattgacagccaggccattgtttctgctattcggcgctacaaccgggagaagataccggtcggcatcatcgatacccccgcagacggtggggatgtggcgattaccgtcagcttcgataattttcaaggtggcgtcatggcggcggaagagatcgttaaccgcctgatcacccgatatggccgcccgaagggaacggtgctgaattgttatggcgctctggcctcagtagcctggcgcttgcgtaaagaggggatggattcggtttttgccaaatatccgggcatcacctatttggctcgtcctaccgatggtcagctcgaaaaaatgctttcggtcaccttgtccacgctgtcggaataccccgaccttgatgctgttcatgccccttcggattccccctctcgcggtatcgtcactgcgctgcaacagaaaggccgctggaagaagataggagaggcgggacacgtcatcttcgttaacattgatggagaacctattgcgctgaaatggattcaggacggctatatggatgcttgcatatctcaggatccggtggcctatggcgagattgctgtcgatatgatcgtcaagcacgcgctaaaaggtgaagctgtcccgctgggcacttatcaagacaaaaaatacttctgggagtcgggcgagattgtccaaggcaagaccgggccgacgctcatcatccccgccttcgtgatcaatcgtgacaatgtgcaggatccgcgccattgggcctcggtggcggagaagacatggggcatcccctatacctgatcatcgcagcggaccccatcgtttcgtaggcccagatcagcgtcggagaggggatgattgctctgacatttatccggcaaggtgagggtgagcgagcgataggtttttatgctcaatatggccttacacataacatggtttacacccattaacggttttacacccattatgattttacacacagtgcgcgacgggaaggcggcggacgatccgattctgaggatcgagaatatcagcaaaaactatggcccggtgcaggccttgtgcggcgtgacgaccgcgatccggcgcggcgctattcacggacttcttggcgagaatggtgctgggaaatcaacgctggtggggattatctcggggcaggtgacgccgacctccgggcggatatttatggatggtcgccttctcgaacatgttgatgttaaagcgatggaggaggcgggcgtctttctggtcacgcaggaaccgatgattatcgacaagatgaccaccgcagagaatctgatgttggggatctggccgaccaagaacggtgttatcgattggaaaacattgcgatccgatgcggcgcggatacttgatgggtccggcatcaatgccagcacccttgccgggcatctggacgcagtcgcgcggcgcaaattgaatattctgcgggccatgttttccgggggcaaagtcatcattcttgatgagccgaccgccgcgttaaccgttgctgatcggcgtcaactctttgactttatgcgtcggctacaagcggcgggtgtcacctttatcttcatttcacactaccacgacgaaattctggcgatctgtgatgcggtcacggtattgcgtgatgggcgcctggcgggcggctccgatgatatcgggtcgatgacctcagtagcgttgagcgaatgggtgattggacgggggctagaacttttccaacgtatacggcgcgatcacaccggtaaaccgcccgcagtttcgctacgagggatacaggggaaggcgctgtcgttggacagtcttgatatcggcgcgggcgaaatcgtggggtttacgggcctgccgggggcgggtgcaaaggaaagcgcacgtgccatttttggcctgtatccggcccgtggcagcatctcaattaacggtgaggccgcacaggatctgccgaaaaggccacgcatggccttcaatattggcattgcttatctttccgatgaccgccgtcgcgagggagtggttgggcagatgtcgatcggggccaatatcgccctctcttctttgccctcgcgggtgagatggggggtaattgatcgccgggctgaagcgttggtcattgcacactatttcgcggcaatgggcgtgaaggcgctcagccccgatgatgcggtgaataccctcagtggcggcaatcaacagaaagtttgtctgggccgagtgtttgcaacccaacctcgtctgctgatggttgatgagccgacgcgcggcattgatgtgggtgtcaaacaggacgtgctgcgcattattgacgaactgagtgatgcaggcgtcgcagtgattatcgtttcgaccgatatggatgaattggcacgctcagttgatcgggtctgcattttcgaacatggcgctattaaagagatattgacgggagatgacatcaccgccgaacgtctgcgggcatctgtgcaggcataaagccacgggataataaccagagcggagagagggaaatggataaggcaaccgagacccgccgcgggggagcacctaccgcgagcaaactcaacggccaggccatgctgggctgggttttacaccatattgtctggatctggctgattgcactggttgtcatctttggtgtcttcaatgaatttttcctgacgatatccaatctgcaaaacgtgatggtgcaggccacggttttgggaaccttagggctggcggtggcactgccgctgctggtggctgagattgacttgtcgattccggcaaatgcgggtttc

(The sequence listing continues in the following parts.)

The invention claimed is:

1. A genetically attenuated *Yersinia pseudotuberculosis* cell, wherein one or more genes selected from HPI, yopK and psaA are deleted or inactivated, and wherein nucleic acid coding for expression of at least one *Yersinia pestis* Caf1 polypeptide at the surface of said *Y. pseudotuberculosis* cell is integrated into the chromosome of said *Y. pseudotuberculosis* cell.

2. The genetically attenuated *Y. pseudotuberculosis* cell of claim 1, which is a live cell or a killed cell.

3. The genetically attenuated *Y. pseudotuberculosis* cell of claim 2, which expresses said at least one surface-expressed *Y. pestis* Caf1 in oligomeric form.

4. The genetically attenuated *Y. pseudotuberculosis* cell of claim 1, which expresses the *Y. pestis* F1 protein at its surface.

5. The genetically attenuated *Y. pseudotuberculosis* cell of claim 1, which is surrounded by a *Y. pestis* capsule.

6. The genetically attenuated *Yersinia pseudotuberculosis* cell of claim 1, which derives from a cell of the *Y. pseudotuberculosis* IP 32953 strain, the chromosomal sequence of which is the sequence available under accession number NC_006155 (SEQ ID NO: 19), by:
 deletion or inactivation of one or more genes selected from HPI, yopK and psaA, and by
 chromosomal insertion of nucleic acid coding for expression of at least one *Yersinia pestis* Caf1 polypeptide at the surface of said *Y. pseudotuberculosis* cell.

7. The genetically attenuated *Yersinia pseudotuberculosis* cell of claim 1, wherein at least one transposon carrying the caf operon is integrated in the chromosome of said *Y. pseudotuberculosis* cell.

8. A composition comprising a plurality of genetically attenuated *Yersinia pseudotuberculosis* cells according to claim 1.

9. An immunogenic composition, comprising an immunogenically effective amount of live genetically attenuated *Yersinia pseudotuberculosis* cells;
 wherein the HPI gene is deleted or inactivated in the *Yersinia pseudotuberculosis* cells, the yopK gene is deleted or inactivated in the *Yersinia pseudotuberculosis* cells, and the psaA gene is deleted or inactivated in the *Yersinia pseudotuberculosis* cells; and
 wherein nucleic acid coding for expression of at least one *Yersinia pestis* Caf1 polypeptide at the surface of said *Y. pseudotuberculosis* cell is integrated into the chromosome of said *Y. pseudotuberculosis* cell.

10. The immunogenic composition of claim 9, which comprises a single unit dose of the live genetically attenuated *Yersinia pseudotuberculosis* cells.

11. A method for treating a *Y. pestis* infection in a mammal, which comprises administering an effective amount of the immunogenic composition of claim 9 to said mammal having a *Y. pestis* infection to thereby treat the *Y. pestis* infection in said mammal.

12. The method of claim 11, wherein said mammal is a human.

13. A method of immunizing a mammal against *Y. pestis* infection, comprising administering an effective immunizing amount of the immunogenic composition of claim 9 to said mammal.

14. The method of claim 13, wherein said mammal is a human.

15. A vaccine comprising an immunizing amount of live genetically attenuated *Yersinia pseudotuberculosis* cells;
 wherein the HPI gene is deleted or inactivated in the *Yersinia pseudotuberculosis* cells, the yopK gene is deleted or inactivated in the *Yersinia pseudotuberculosis* cells, and the psaA gene is deleted or inactivated in the *Yersinia pseudotuberculosis* cells; and
 wherein nucleic acid coding for expression of at least one *Yersinia pestis* Caf1 polypeptide at the surface of said *Y. pseudotuberculosis* cell is integrated into the chromosome of said *Y. pseudotuberculosis* cell.

16. The vaccine of claim 15, which comprises a single unit dose of the live genetically attenuated *Yersinia pseudotuberculosis* cells.

17. The vaccine of claim 15, which is formulated for oral administration.

18. The vaccine of claim 15, which is formulated for subcutaneous, intradermal, intranasal, or intramuscular administration.

19. The vaccine of claim 15, which is formulated for non-oral administration.

* * * * *